United States Patent 10,233,495 (METHODS AND COMPOSITIONS FOR SCREENING AND TREATING DEVELOPMENTAL DISORDERS) - sequence listing, part 23

SEQ ID NO: 121 - DNA, 77880 bp, Homo sapiens
acttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccc

SEQ ID NO: 122 - DNA, 122276 bp, Homo sapiens
tatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 123 - DNA, 213430 bp, Homo sapiens
tcccttcaacatgcgtaatatataacaagattagtgatcttccacctaatgtcttggacaatgtgacttctgtctgataggtatagtctttgacccctacttactcatgattaaagaaatacctttctctcaaaggaactatctgtgttcacagcgttaagtctcatcctggatgctgcaagaagacgttcaaatgtccactgcccacccaggtatgtgatgctgcctgccatgggtcactagaaggtgatagttaaaagtgtaggctctggaatcaaacaatgcagaccacaattctggctcctctgctcaaatgctatgtgaacgtgagcaagactgtgaacctctctatgcctcacttcctcacctctaaaatgaagataatagtacctacctgaggctgagcacagtggctcatgcctgtaaatcccagcattttgggaggccgaggtgggtggatcattccaggttgggagttcgagaccagcctgaccaacatggagaaaccctgtctcgactaaaaatacaaaattagctgggcgtggtggcacatacctgtaatcccagctactcaggaggctaagacaggagaatctcttgaactcgggaagcggaggttgtggtgagccaagattgcaccattacactccatcctggatgacaagagtgaaactctgtctcaataataataataataataataataataataataatacctacctgatagtattgggttaaataagataattcatgaaaatccctagtgtggtgcctaaaactcaaacgctaatatacataggtttggcctaatattatgaggtgttattatttaggattgctgtgcttcagctttttgttgagtttcacggtttggctcttactggaccactgacagaagcaactccatgactggttattctgtcattacccccagatactgtgcgataccttccaaatctactacaaacaacgagtgtgcatttctcttgcttgttccatccaagaggaaagagatctgtccagagatgtcattctgcttcagtcaacccagccgtgccagacaatatcagcataaatgtcaaaattaccatatgtggtcaacatatgctgatactgtgaccatatgctacatgggacttgttcccttaattgtgaataagagaactattcgtgtaggtgttattatccccaattttataggctcagaaagagtaataattggtccaatgtctcacaactgtatgtttcatggcaaagattggaaatgaagcaataacttttttctagtaaaattacaagaatgaccttaatttctttctaagcaaacgtagcgtatcatcacaacagttatgttaaatcagctcaataatctcctagaagaacatattataatattcattagaggtggtatgggctttaagagggagaaaaaactaggcaggatattgctatatgtgaagtaccatgctagatatttcacatatggtatttcatttcatccataccagcaacccaaaattatgttatttatccctgttttactaacaaagaaattgaagtttaaggagggtaagtgcaggatgaacactaagccaattgtagagctggcttttgtaatcagggattttatttaattcgatttgctctactatcatcatgttgaattaagaatggcaaagggctgggtgcactggctgacacctatagttctagctactcgggaaactgaggcaggagggttgcttgatcccaggagttcgaggctgcagtgagatatggtcatgccaccgaactccagcctgggtaacagaatgagaccctgtctctaaaaatttaaaaaaaaaataagaaattttcaaaaaagaataaaaattaaaatatatatatattttaaggctgggtgcggtggctcacgcctgtaatcccagcactttgggaggctgaggcgggcggatcacgaggcgggaaatcaagaccatcctggctaacatggtgaaaccccatctctactgaaaaatacaaaaaattagtcgggcgtagcggcgggcgccggtagtcccagctactcgggaggctgaggcaggagaatggcattaacccaggaggcggagcttgcagtgagctgaggatcatgctactgcactccagcctgggcgacagagtgagactccctctcaaaaacaacaacaacaacaacaacaacaaaaatttaaaaaaatgtgtgtgtgtgtgtgtgtgtgtgtgtatacatatatatactttttttttttttttaaagaatgagaaaggaactagaacaagcagagagaaaaagcccaggggcacgacagctaaaggatgactaatggaagttgaaaataggaagctgaaaggtacagaaatactgcgggaagacaaactacaaattatgtggagaaagacaagaataagaacagttcccagaggtctgaacacagcacattatgtcttcttgctatacagtggccaccaaacttgtcaatactgtaggcaaatgctagtgtcattgcttgtggctaagcagaaattttgacacttgggaaggttggcatgagattgaacagttgccatggtgacctgccatagatattttgattgatgatgagtagacacaaagtgccaatgcttaagacctagcttcagatacttaggatttagtggagaggctgttttgactatttcttttcttttcttttcttttgagacagagtgtcgctctgtctcccaggctggatggagtgcagtggcacgatctcggctcactgcaagctctgcctcccgggtttacgccattctcctgcctcagcctcccgagtagctgggactacaggcgcccactaccatgcccggctaattttatgtacttttagtagagaccgggtttcaccgtggtaaccaggatggtctccatctcctgacctcgtgatccgcccacctcggcctcccaaagtgctgggattacaggcgtgagccaccacgcccggcctgactatttctgacatctgacttaggctgcacaggaggtggggtttcttgacagggaggagctaatgtagggactgtgatgtgccaggctatttgggttggggtggagaaaccacagagagacagacataagctctctcccttatttataggacatacctactggtcctgccctaggccccagattctttgttagtggccttttctactgggagcaggtggggcattccagtttcaggtgttctgggacctggcttgaagtttttcactgatggctgcatcattaggctcgctcttttgccctttcctcagttcctgtctttttttcactttcagtcacctagaaacgacaatatccaatcagaagttgagaatgagacaagtttgggaagacattgaggaatgtctcatattgtggtattgataaatctagagatggggccacagcttgcttatagctgcttagagtaaaatgattaatcagaaaaagtaatttccaaggatttgtagtcagtctgcctgaggctaatacatttattcacagcaaaatatctgctgcctaaaatgactctgcaagttacccctacaataccagctactcagagtgatgcaatcacctggttgcaataggaaattatcctggcttcagttatctagtagaacaggtgtacatatcaatcttagagctcttgagaagacccagtagccccagacccgtgcaattatattataagcactcaagtaacttctcagctaaaggaagaatgatgaagcaggaaagagagaaaaatgatttgtattttttgtggttaacttgcttagaaattttagggaggataaactcaatcttgactaataggaaatttaattaatttagagagttattaaataatagctcctccacatcagggactatgataaatgttattaacaacacaaagaagaataagactttcccttctaggaacataccatttagtgggaagaaagacagacagatacacacacacatacacacacacatgcacatacacttaaacagaagtggtagaggctgagggaaatcccataagatagacataaagaaagtgctccatttgctcagagttagaggtgaaaaccaagaatattggcagaaaagaatgttttaaagcaactttgaatgattcttccaatgatattggaattagaaaatgaaggtttaggcagagtggggagcaggacagtcactgaagtgggaaggcacacatgggctcagcaaaaccggagcacagtgtaatatcattaggggtgaagtcaagaaaagtagcttaaaattaagccatagagaatccaaagattttaaattttcttttgatttcaaaaatgatcttttcatattattgagccagaaaataattaagtcatctatatattagacaaagttgtcaaaagcaactaaatggagggatgttaaaatgggaaagaaaaaagctagcacatttaacctatagctaacaatactgtattatacacttaaaaatgtgttagcagggtaagtctcatagcacaaacaataaaataaatttcttaaagaaaaagttaactattggaatagcctagacaagaaattatgaggctttgaactgaaacaacaggaacagaatttgaaagaggagaataaacccttgggatacagaatgaacaaaattttaacactgtctgctgtaaaaagtgagggagatcagagggattaaggtgacccttggatttcaagaataaaaatatggccaacaaatccagggaacacagatgaaagagaatattcaataaagaagacatacaaattcaaatggggtcattctgaaattgtggcacatttgagatatcctcatatctatccttataatcaaaacaaactcactatctgctcattctatgaccagtgacctcactcactgctgccttatacttcagggcttacacgtagacacacacacacacaggcacacacacacacacacacacacacacacactaagaaaagtagcttaaaattagaccatagagaatctaaaattttaaaatttagaacagatcttcatctgagccaggaaccattcatctatggcttctgtcatttaatagaataaacaaaatctgcatatgaatccatgcagaactccaagttcagcatggtttctcactgttctcagagctggtacctgaagctgcaggtgtgcattctctgccacactctgtaatggatgagtggaaattcttccataaagcttttgtctattgggagcaggtaagtctaggcaaagtatgcacaatttttttttctgggatacccagtggaaaaaaatagaaaagcatcatttttaaagtactgaaagaaaaaaagtcaacctgaaacaacctcattctagccagggaaaattagtcatttcaagaaaataagagacaatcagactagaaaggaagatataaaacaatctctaactacagttgacacttgacataatcttgtatatagaaaatatgaattctcatacacatacacatgtacacagacaactccactagatttaataggcaagctcagcaaggtgcagaataaaagattgataccaaaagttctattgtatgtctgtatgttagcaatgatatgaaaatgaaattaagagcagaattatgtgtataattccaacaaaataataaaatatcttggcataaattaaacaacaacaaaaaaaaaaaacagaaaagacttgtgggctgaaaggtgcaaaatattgttgaaattaaagacctaatagaaagatactccatgttcatgggttggagggcttaacattgttaagtggcaacactccccaaattgatttatagattcatctctgtcaaaatttcaaaattctagttgtattttttttttggaaactgataaaccaaagtaaaaattcatatggaagtcccaagtaccaagatcagccaaaacaatgttgtaaaagtagaaaaaatgttgggcaactcacacttcacaatttcaaagcttattactaaactacattattcaaaacagtatggttctggaacaggataaacatataaatcaatggaatagaattgagaaccctcaaataaattcataaatttatgggcaattaattttagacaagagtgccagccaagaccattcaatggggaaagaatggtaaatggtaccaggaaaactgtgtatgtatgtgtaaaagagtgaagttgtatcttgtctcataccataaacaaaaaataactcaaaatgaattaaagacctaaatgtagaagctaaaactcttggaagaaggcataggtatacatctttgtgaccttggtgtgtatgtaaccagcagcaaatccatatgggtctgcagtaaactcaattctagctcctaggaggagagaatttggccaaggggcagaaagaagtttaaggcagaggaaaagacccgggcaagttttagagtagtagtaaaaggaagcaaagtatacttggaagagggccaagcgggtgacctgagagacctaagggccctgtttagcccttgacttagggttttacacatcaccatggttctagggtttgtgtttctcctcccttgatgttttcaccttggggcaagctgtctgtgtgctcagtggcctgccagcacttgggaggggctgctcatgtagtgttcttactggagttgcgcacatgctcacttgaggcatttttcccttaccagtggggtgttcctagagtcatatgttagttaaactccgtcatttagcctctgtgcacatgcttgagcccactcgcccaactccagagatcttatcgggaagctgctgattacaagctccagatgtttttttatctatgtggaaactgtctttcccggatgctggttgtgactaattatcatctttgagagacagtttaacaaccacctgaccatcacctgatgatcacctgacattctggagtgtgtgtggtgggggtcggggggaggggggagagggggtctcttctcgtgccctcttcatatctgcctacctattctaacaggtatacatgaagcagattcgctgtgcactgttactaattccaggggattgtgttaattttccagggagaaatgcatgaaggatagtggaggtcatcaccatgccaaccaccacttcacagcccactgcatcttgaactgcaatttccatcacttgcctgattcatataacaagttgagcaaagcaaatttattactcacagacaggcagcaaaggacagtagaagcttaggattcatggtgagtttgtctctcaaggctcagaaaaactacacaggatggatagaatcttgcctgcatatgcctcatgttgcattgcagctgagtggctctgaaagtgcactctgtcctgggttttaaacccaggggctacatttaatgggttaaagcactgtgggacatcctgttccaggagagacaagaacagaggccaggattttcctgccagttcctcattatcacaggatgtggtattgctagcacatcctacagttattcttaagaactataaaagagaaaagggagatccacattgccaaggccatccagggacttatccttcagagtaggcagtgacttcttaaatatgaaactcaaaacacaggcaaccaaagaaaaagataaatttgacttaataacattttttaaagtctgtgcttcaaaggacactttcaagaaagacaaccccaaaatggatatatacttgcaaatcatatatctcacagggaattgtatcaaggatatataaagaactcttacaactcaataatataaagacaaataacctaatttaaaaatgagaaaggatctaaacatgtctccagagaagatctgcaaatggccaaaaaatacatgaaagatgctcagcatcattagtcgttagtgaaatgcaaatcaaaatcacaatgagataccacttcacacccagtaggctgtaataaagatacccagacaatagcaggtgtaggcatagatgtgaggaaattgggaccctcaagaattgctggtgccattgtgtaaaacagtccagcagttactcaaaagttaaacatagaatgaccatgtaacccagccatccctctcctaggtatacccctcagacaataaaaaatatgttcacgtaaaaaatttatacacacacttcaaacagtattattcatattactcaaaaagtggaaatatccatcaattgatgagtggattaactaaataggttttatttctaaaataaaactggtgataaaaaggaacaaagcactgatacatgctataccatggatgaacattgaaaagctatataaagtgaagaaggcaggcacaaaggggcacatattgttggacttcatttatataaaatgtctagaatagaccgggtgcagtgactcacgcctgtaatcccagcactttgggtggctgaggcaggcggatcatgaggtcaagagatcgagaccatcctggccaacatggtgaaaccccgtctatactaaaaatacaaaaattagcttgtagtggtgcgcgctcgtagtcccagctactcaggaggctgaggcagaagaatcacttgaacccgggaggcagaggttgcagtgagccgagatcgcaccactgcactccagcctggcaatagagcaagactcagtctccaacaacaaaaacagagtctaaaataggcaaattcttaaagacggaaaatagattaatgattgccatgggctgtgggaaggaataaaagtgaaatgacatctaatgataaagaatttctttctggggtgatagaaatattctggaattcatggtgacagttacagctttgtgaatatactaaaaaccacttaattatatatttgaaagggtggatgttatggtatgcaaattatatttcaattttaaagaaaatgtcaacactcaacatgaaaatattcaaaattacagctccaacatcagaataaagactatatttttggatctctaggattctgatatgagtaagaccatgagtcattattatttggacactaaatgttaacatgatcttatttattattcaagtcatacacctaactcctctggggtgcctatccaatggagtgagattgtgccttgtttcctgtatctttctttcactactcctgggacaaagtagactttcacataatttttattcaatgctgcaggatgagaaaggacagaaaaatgggaggaagaggctgggcgtggtggctcacgcctataatcccagcacttcaggaggccgaggtgggcagatcatgaggtcaggagatcgagatcatcctggctaacacgatgaaacccagtctctactaaaaacacaaaaaattagccaggcgtggtggtgggcgcctgtagtcccagctactcgggaggctgaggtaggagaatggcgtgaacccaggaggtggagcttgcagtgagccgagatcacgccactgcactccagcctgggtgacagagtgagactctgtctcaaataaataaataaaaaataaaaagggaggaaggaagatctctcaaacacaggcatcccatgcatgactacagagaatgatacagataggtatgcagaataacgggacctgaggtcagagggggaagtctttttagagtttgttctttgaatcacttatattgaaaattcaagtggaataagtgaaggtgacaaaagtgaattacaaatcttaaagttccctgaaaatgcttgaagccatcccttagctgaggtgtgggagtgaaaaagcaaactgagacaatgtgaaatcattttctatctcgaattttccctccagcaatgttggtgtccacttccctgtctcttaatgggtgcatctatatatcacctcttgtcaatacctctactcagcaacagccagaaaatagaaagattatataagccaataaaaggaaaataaaggaacaaaaaataagaatagtggagagatcatctacttgggaggctgaggtggggaggattgcttgagcccaggaatttgggaccagcctgggcaaacagcaagaccccatttatgaaaaaaatgaataacattatctgggtatggtggcttgtagtcctagctacttaggaggctgagatgaaggactcacttgactgatcctaggagattgaggctgtaatgagatatgattgcactgctgcactccagcctgggcagcggagctagatccagtcttgaaaaaaaaagaaaaaaaaggtgaagagggaaaaaaaagaacgagtaatagaggtgcttacttcacaacactaacctcacaaacacacactaagctaggttgtgtgtataggtcagaacaaaagatctaccatttaactgacatataagattggttctcgaaaccataggacccactggaaatggtgacctcacaggaagatgcatcttgtaggaggcagctgtgaggtctggttccccgacgtgctgcagcaagtgcctttgccctgcctgtgggctccctccatggccaactctgctatggacaccagagtactctgctgtgcggtcatctgtcttctgggggcaggtgagttttcagctaaaggatcaccatcactgggctttgttttgggctctacagcagattctcaaatataccctggacctctgtgttgaccaaatattttgtgaaaggtattgacatttatatgaaaacaaataattgcattatggagtaaaaagcaaaattcatgtgagtttttaaatgaacgcaggagacttcaaacaggctccttcactgtaagacattcatccttctgccattacaactctgtctcatgcagtctcttctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacccacattgatgcagagccacatcctctcagtccacaaacatcctccagacctgccttggaaacagcggtgggccaggaagggaaacgcgttacctgtacagtgaacaggtcagctctacggtattctgcaagttgagggtggaaataggggaggattgtaggaatagcatgaaacatcccaggctacgctcagaaactaagactctgtcatccaaagaacataaagatttttaagaactagacataatttttcagtttcaacattgacttaatttgtcagtttcaaaacacttagcagtgtaactctgttttttactccacactgtatgtcaagttctatatttcatgctttacatcaataattttatttaatcaccaagacacacaagcaaaggaagtgctttcttccttttcaccaagagaaattatggtcctaggagttaatttttagaaagaaagagacagagagatgggggaagaaaggggaggggaggggacaggaggagaagggaagggaggggaagggaggggaggggaggggaggggagggaagggagaaggaaacctagtaggtggcaaaaagcatttggctcaaagggttatgatttttatctcacatcatgctgcttagcattcttttaggcataatccttgttctgttccttgctgagtacccgtgcaggtttttacggatgctaggttcaagaattcctgctataaaattatagaacatctgagagatgatggaaatagagttggataaatttgtctagaatttagggaaaaggtctggcccacagatattgttcattagaaatgtgtcacctcaactttttgtcttaatgtttgtttttattctcatcactcaacagatataggccacctacagaaaaagatttgttataatttgctttgatgaaacaatttcataaaatcaaaaggcagacaaaagcaaagtcatttcaaatatatgtgcagactaagtccagcctcaccagcttggagtataaaccatgtgattccactgcagtttttgccctttgattttctaaaatcatttaatgtactcctgcccctccctcactttacccaaaaggagaaaaacccagaaaatcttccaggaagacagaagagggacaccggcttgggagcctgagaaagatccagagagatttccagaaaaagaccaaccctgagaccccagcaaggctgcagagaagatggattccaaacttcatgccatttaaagcaccagacatgtaatttaaagaaacagtcttccaaaggtagtgctttacagggaggggaaaaaaaggcaaagaggaagaaagagggtcttctggcaattcaatagtgaggagaaaaagaggaaaaaggggaaaactgagaattctgcaaaacaaaaggaaatcacaaatcaagaggacccacaaccagccccactacgaaaacaaacaaagctcactaaggagtctggattttgctagaatgatggccaaaggaacattagactaggaattttgtaaaacacctcaataacacgaaaatgagcaagatgaaagtaatacccgtacaacaaaggaaaacatctcacctctgttccctgttccctcatctcaaaagcaatcatgagtcagaagataatgtaagtctacactccaaacagaaataaatacactcaaggaagcagctgaggatataagtgaccataaccagaccaggactttaaaaactcagactacaaatggccaaaatgggaagacatcagaaaaaaacacaaattgattgaacccaggagggacatgaaagaaaaagacaaagttatcccagtcatgcaaaataaaagatgaccaagggagaataaacccaaatgaaaatttagtcaggacattgaacaaaggcaaagaaacaagtagcagaatgagaaggacatgagtgaaaccagccagttagaaggcggtcaaagaaggcgaggtcttggtatgattgcatgaggggcctggaacagcagcactgggctctgtgcagcaggacggctaagcagcaggttgtcacagtggccacagcactactggccagaccccaggagtcacagtttccctgagagagctgagggcataaacaatgataagttctccaggggatggacttcttaaatactctgagttcatcattacacattctatgcatgtagcaaaataccacaggcacccacaaataggtacacatattatgtatcaatgtttttttaaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatgagtcagtgaagaaaagaatgaaagtttactgtttagcagtgtggatctctaatccgacttaaaactccttgttcccgattcctattcctcctaagccagagatccctgggtccagggtgagggcacggcattcatgcttacccacgggctggtcaacaaagaggtgctgacctgagagtagggcacataacctcagccactggggtacacttaccacccccgcccccgtgtagctccctcccctatcctgaaatctcccttagcacactaagtattctaggttaaacagcccagatgttcagggagttcattcgccacaaacacacattaaaatgcagacaatttgcctgtgagatgaggaaaattctctggaagatttaggccctgagagctgaaaagggaccctaaacattacctggtgacaactgccctgaggccagagaagagaactcacaatattggtatattaaccggtaccatttgtagttaggctgtcattaatctgggtgtaatggggctcagctacagagaagcgtatccagaggaaatgtggggttcctgcagtcagctggggcaccgaaaagacccagactttagaaccagataaaggctgagttcgaacctctggttcttttgtgatgtggtgaccttgggcaaattaatgtgtgaacctcagtttcctcaactataaaatgtaatgaacaatacctaccacttactattgctgtgaggaagaaaagagagtcaacatgtaccgtgtacagattattgatgtaattcaatggttcttttccccatcctcctaggaggtcactggggagacagggggcagggtcagcccagtgccaaaggatgggcaggatctgaagtgtggaaatggagtaaggctgtgtctgtgtcagaggtgggttgggaagatgtgagacaaacatcacaattttgcctaaggtgaatccaacccacaagtagagcacaggccaacagcagctcactagtacacatacttacaccagcagctcactagtacacacacttacaccagacgctcactggtacacactcacaccagagctcattagaacacacacaccgtcagcttgctagtacacacacttacaccagaagctcactagtatacacttacaccagaagctcactagtacacacacttactccagaagctcactagtacacacacttacacccacagagacaagccccacaccacacggactcacaaatgcagaagaagagttgaccctgccctcatgtacagatagtatgctggtgtgtagtgagaggcggctagtgttcgcca

SEQ ID NO: 124 - DNA, 102234 bp, Homo sapiens
aactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 125 - DNA, 131541 bp, Homo sapiens
aagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactgga

SEQ ID NO: 126 - DNA, 196831 bp, Homo sapiens
aagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 127 - DNA, 15302 bp, Homo sapiens
tgaggaagggaacagagaagaaatggtgtttcttcccatgtccctaacacccacatggaggccacatttggaaatggactgggagagggaaaggatgaggaaaacagctgcccaggagtctccttctccaccctgggttcatatcagaccccatccctaccacttgcctcttctacccctggaaaatggacctaacaaacagaaggagcaaaataaattaacactctaatgagcatgtatggatggacatatgttcatgtgcaatgggggaagggaagagggggtgacaccacctaaaatgattccccacctcaatctcccagcctactcctttcccccttccccctaaagccaccatccaaccagatagaaaaataaaggtctaattcactcaaaattcttcagtttttacaaaactaacagggcagagtagggagacggggggcaggcagccacaggagtagggctggtggagaggggctatgcttctgtctccacttgagactggctctctgtggtgttgctcttctgctcctccatctctgtgtcagtgagattgtctcctgaggaagcctctgccttggccttgttctcttcctcagccagcctctcaaacgtgttggcgtagagcgtcttctcccaggcaagctgcctgcagatctgctgctggcacacagccagctgggccttggcggcttcgttgttggggtagagctgcaagaccttctggaagtcagcctgtgccagttcaaagtcattcacagccaggtgggcctctccccaatggaagaggcccttctcgttgttgctgcccagttccagggccttgttacagctttcagtggcagcagagaaggcctgtagtttcagatgacacatggccaggttgaggtaagaggccagttgaagggcctgtgccttctgtgtttcctcattggaaaaactagactcatattctacccaggacacaatcctcttatattatagtaaagcttgcttgtatttgccttccttgaagtacacagtgtcccactctttcactgtggtgctctgctccagcttctcttctgaattcatctcccaagactccttggtcttttcaaaactcttgaggtgtaattcatatttcagctaggcatttggtgggatttggaacttttccttcctaacactgccaaaagcatagctgggtttgaggtacacaatggaatgttctcctttctacatgcactgaatggccctctccagaccataaggcagatccagattctcctgatgttcaaagaactagtccttgtagcacccttccagtgcaatctccatgatagcaccctcattgggcctgggatagccttcaccgcaagtctgtaattctgtagatgattccgccatcttcttcttccgtcagatcttctcccttaaactcaaacaactccacctcaaacacgagtgtggcattggggagatctttggaggactgcctgctgcaccgaaggcatattctggtttgcaggtgatatggcacacctcccctgccttcatggctgctatggcaatgtcccaagccttgttgacctccccttttcccaggtcaaaggagaatttgtccttgtgatccagactggggtcaaagtttgtgccatctaacagccagccagtgtagtggacaaagattcagtccccaatcatgggcatctctgtacctgtgccctctctcgatgaccttcagcatgccttcctcctgtttgggcgaatgtccactccctccatgggaagaggcgccaactgtgtcccattctcagtctccttcatctcctcaactgtcatctccacgcagcgcaccctttctgggagctggcaccggcaccagcatactctgagccaaaggcaggggtgctaccttcagggtgtgcaggaggccaggtgctgtggtgctgactgcggaccacatggaggctggagcacctctgccagtctgtagtatgatttgaagtcaggtaatgtgattctctccagttttgttctttttgctcaggatagctttgactattctggatcttttgttgtaccatgtaaattttaggatagttttttattattaatatttctgtgaagaatgtcattggtattttgaaagggactgcaatgaatatgtagattgctttgggtgatattgacattttaacaaaattgattcttcccatccatgaacatggaatgtatttctcttttttggtgtcctcttcaatctcttttatcagtgttttatagttttcattgtagagatcatttctttggttaaatcctaggtgatatggtttggctgtgtccctacccaaatctcaccttgaattgtaatagtctccacttgtcaagggtggggccaggtggagataattgtataatgggggcagttcccccatactgttctcatggtagtgaataagtctcatgggatctaatagttttataaatgggagttcccctgtacaagctctcttgcctgccaccatgtaagacatgcctttgcttcttctttgccttctgccatgattgtgaggccttcccagccttgtggaactgtatgtccattaaacctttttcctttataatttacccagtctggggtatgactttattagctgcatgagaacagactaatatgctacatatctaattttatttgtggctattataattaggattactttcttgatttctttttcacactgttcactattagcatatacaaatgctactgatttttgtatgttggttttgtatcctgcaactttacaaaatttatcagttctaatagttttttggtggcgtctttgggttttcccaaatataagataccatctgcaaacaaggataacgtgacttcttcctttccagttggatgccctttatttcttcctcttgtctgattgctgtagctaggacttctagtactatgttgaataacagtggtgaaagtgggcatccttgtcatgatccagatgggagagggaaggttttcaggttttccccattcagtatggttttagctatgggtctgtcacatatggttttaattatgttaaggtatgctccttctatacgcagttttttgagggtttttcatgaagggatgttgaattgtatcaaatgcttttttaacatctactgacatgatcatacggatttgtccatcattctactgatatgatgtatcacattgattgatttgtgtatgttggaacatccttgcaagccagagataaatcccacttggtcatgatgaatgaccttttttaccatattagtgaatttggtttgctaataccttgttgaggccttttgcatcaagattcatcagagatactggcctgtagttttctttttttgatgtgtctatgtctggttttggtatcagagtaatactggcttcatagtatgtgctgggaagtagtccctcctcctctattttttcagaattgtttcagtaggattgctattagttattttttaaatgtttagcataattcagtattgaagtcattgggtcctgggcttttatttacagggagatttttaattacaacttcaatcatgttacttgttattggtctgttcaagttttggatttcttcatggttcaatcttggtaggttgtatgcatctaggaatttgcccatttcttctagattttccaattttttggcatacagttgctcacagtagccagaaattatcatatgaatttctgcattatcagttataatatctcctttttcatctctgattttacatatttggatcttctttttttttcttaggcaagctaaaagtttctcaattttctttatctttaaaaaaacttttcgattcattgatcttttgtattgtcttcttcatttcaatttgatttatttctgctctgatctttattattccttttcttctactaattttggatttggtttgctcttgcttttctacttctttgaggtgcatcattaggttgtttatttgaagttttttttttttttaatgtaggcacttatagctataagcttccctattagtactgcttttgctgtattccatacaacaaaatggtatgttgtgtttccattatcattttttccaagaaatttttcaatttccatcttaatttcttcatttacccactggttgttcaggggcatattgtttactttccatgtgtttgtatagttttcaaaattcctcttgttattgatttctagttttattccattgtggtcagagaatgtgcttgatatgattaacatttttttgaatgttttaagacttgttttgtgacctaacatatgatctgtccttcagaataatctatatgctggggaaaagaatgtgtattctgcagtctttgaaggaaatgttctgtaactatctattagatgtttctttgttgattttctgtctagaagattgatgcagtgttgaaagtgggatgttgaaatctccagctattattatattggggtctacttctctctttagctctaataatattttctttatacatctaggtgctccagcattcagtgcatatatatttaaaatcgttatatcctcttgctgaattgaaccccttatcattatatagtgaccttctttgtctattcttacagtttttgtcttgaaatctattttgtctgatatgaatatagctgcttctgctcttttttggtttccatggacttggaatatcttttccatccctttattttccatgtgtgttttataggtgaagtctgtttcttgtgggcaacagatcattgggtctcagtttttggggggttttttggtgtgttttgttttgttttttgtttattttttggcttttggctttttttttttttttgagatggagtctcactctgtcaccaggctggagtacggtggcacgatctcggcttgctgcaacctccgcctcctggattcaagcaattctcctgcctcagcctcctgagtagctgagactacagacacacaccaccacgcccagctaatttttgtatttttagtagagacagggtttcaccatgttggccaggatggtcttgatctcttgaccaagtgatatgcccacctcagcctcccaaagtgctgggattacaggcgtgagccaccacacctggcctcattgtttttttattccttcagctactctgtgtcctttgaagaactgtgtccatttacattcaatttatagataagtaaggacttacccctgccattttgtgatttgttttctggctgttttgtggtcttctcttccttctttctttccttcatgtctttctttttgcgaaggtaattttcattggtgatatgatttagttagttgctttttattttttgtgtctccattgtatgttttttgatttgagggtatcatgaagcttgcaaatactacgttataacccattattttaagctgataataacactgtttgcataaacaaactaacaaaaagaaaatttacaaagacttcctgcattaactttgtgcccctgctttaagtttttgttactatttatatcttattgtaatatgtcttgaaaagttgttgtagttactatgtttgattggtaagtcatttaatctttctccttaaataacagtagtttacacaccacatttacagtgctataatattctgtttttctgcagactattactagtggattttgtaccttcaggtgattatttattgctcattaatgtccttttctttcttattaaagtactccctttagcatttcttgtaaaaaaaaaagtctgatgttgatgaaatccctcaactttttttttgtctaggaaagtctttattttttcttcattcttgaaggatattttcaccagatatactattctagcataaaagttctcttcccttcagcactttaaatatttcattccactctctcttggcctgtaaggtttccactgaaaaggctgccactagatgtgttggagctccattatttgtttcttttctcttgctgctttttggaacctttttttatccttgacctttgcaagttgaattaccagatgccttgagttagtcttctttgcatgaaatctgcttggtgttctgtaaccttcttgtacttggatactgatatctttctctaggtttaggaagctctctgttattatccctttgaataaagtttctatgcatatctctttctctacatactctttaaagccaataactcttagatttgcccttttgaggctattttctagatcctgtaggcatgcttcatggttttttattctttttgcttttgtctcctctgactgtattttcaaatagcctgttttcaagcttgctgattcttttttctgcttgatcaactctgctattgaacgagtctgatgatttcttcagcatgccagctgcatttttcaactccagaatttctgcatgatcctttttaattattttaatctctttgtcaaattcatctgatagaatcctgaatttcttctctgtgttatcttgaatttctttgggtttcctcaaacagctattttgagttctctgtctgaaaggtcacatatccctgtttctccaggcttggtttctggtgccttatttagtttattcattgaagtcatgttttcctggattgtctggatacttgtaggtgttcatttgtgtctggccattgaagagttaggtatttattgtagtctttgcagtctgggctctttatacccattcttcctgggaaggctttccagatattcaaaaggacttgggtgttatgatctaagctatatctgctttagagaggacccccaagaccagtaacactatgattcttgcagactcatagaggtactgccttgatagtcttggacaagatccagaagaattatctggattaccggagactctggttctcttcctttactttgtcccagtctctctctgtgctgagccacctggagctagaggtggaatgacacaagcacccctgtagccatcacccctagaactgtgctgggtcagacctgaaaccagcagagcactgggtcttgcccaagccctgctgtaaccactctttggctaccagctatgttcattcaaggccctgaagatctgcaattagctggtgacagagccagccaggcctatgttcttcccttgagggtgatgagtttctccaagcccaagctccaggagggtccagaggtgccattcaggagccagaaactagagtcaaaaatcttagaagtctacctggtgttctattgtactgtggctaagctggcactcaaaccacaagacgcagcgcttcccatgcttccctcccctttccaaatgcagcgagcctcacctcatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctacccagctgtagggcctaccttatataaactttttatccaggatagctttcttttttgtctttgggacagtattgtaactaagcaaaaagataagcggatttaatttttcttattagtcatttaagatttttatttgccttttataaggagtctttaatttaaaatactgaaatactttagaagcttctgcatatcagtaggcatccatagatgagagtaatttggaaagcttcattttcttttctttttttttaatttcaacttttattttaaatacagggtacatgtacagatttgttacataggaatattgtatgatgctgaagtttggagtacaggttccctcaccctggtagtaagcataatatagtactcaataggtagtttttcaacccacccactcccaagctcgagtagtccacagtgtctatcgttctaatatttatgtccatgtgttctcaatgcttagctcccaattagaaggaagaacatgcagttttgaattttctgtttctgcattaatttgctgaggattatggcctccagctccatccatgttgctgcaaaggccatgatttcatttttttataactgtgtactattccgtggtgtgtatatacagcattttctttattcaatccaccactgatgggcagctaggttgatcccatgtctttgctagtgtgaatagtgcaacaatgaacagaaaagtgcatgtgtctttttggtagaatgatttattttcttctgggtgtaaacctagtaatggtatggctgagatgaatggtagccctgttttaggttctttgagaaatctccagattgctttccacagtggctaaactaatttaaattcccactaacaatgtataagtgtccacttttctccacatcttcaccagcatctgttgttttttggatttttagtaacagccattctgactggtgtgagattttatctcactgtcagtttgatttgcatttctctgatgattagtgatgctgagcattttttcatgtttgttggtgacttgtatgacgtcttttgagaagtatgtgttcatgtcctttgcccattttttaatgaagttatttggtgttttgcctgttgatttgttcaagctccctatagattctggatactaggccattgttggatgcatagtttgcagatatcgtctctcattctgcaggttgtctgtttgctttgttcatagtttcttttgttgtgcagaagctttttagtttaattagatcctttttgtcttgttgttgttgttgttgcaatggcttttcatacttagctaaaaattttttaccaaggctgactttgagataagtatttcctaggttgtcttccaggatctttacagtttgaggaccttcattgaaatctttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcagattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatagtgtagccttgaagttgggtaatgtgatacctctggcttcattcttttgcttaggatagctttggctattggggctctttttcagttccatatttattttagaatcatttgttctgtgaaaaatggctttggtagtttgataggaatagtgttgaatctttaacttgctttggacagtatggccatttttacgaaactgattcttccaattcatcggcatggaatgtttccccatttatgtcatctctgatctccttctgcaatgttttgtagttctctttgtagagatctttcacctccttggctacctgtattcctagatatttcattttcttttggctattgtaaatgggattatgttcttgatttcactctcagcctggactttgttggcatatagaaaatgctactgatttttatacaatgattttgtaacctgaaactttactaaaggtgtttatctattctaggagactattggcaaagtctttaggattttctaggtatagaattatgttatcagcaaacagggagagtttgacttcctttcctatttggatgccttttatttctttctcttgcctgattgttccagctatgacttccagtactgtgttgaacatgagtggtaagagtgtgcatcttggttctgttccagttctcaaagggaatgcttcaagctattgtccacttagtatgatgttggctgtgggtttgtcatagatggctcttattattttgaagtatgttccttcattgcctagtctgttgagggtttttaacatgaagggatgttggatttcatcaaaagctttttctgcatctattgagaagataatttcatttttgcttttgattctgcttatgtagtgaatcacatttattcatttgcatatgttgaaccagccttgcattccaggaataaagcttacttgatcatgttttactaacttttcaatatgctgctggatttgattttctagtattttgttgaggattttcaggtctatattcatgagagatattggtctaaagtttcctttattaattgtgtctctgccagatttgggtaccaggctgatgctggcttcatagaatatattagaaaggaacccctcctctttgattttttgaataatttcagtaggattggtatcagttctttgtatgtctggtagaattcagctgtgaatccatctgagccagggctttttttggttagtaggttcttaattactgattcaatttcagaagtcgatagtggtctattcaggttttcaatctcttcctgattcagtcttggaagattgtgtccttccaggaatttacctacttcctctagattttctaatttgtgtgcatagggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggtagaacacaaaaatccctataaatttccaaaaccaaagtttgcatcccctgaaatattgccattttctactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggatcccacttctgacaccatctgtttaaaaaaaaaaaaaagccttagacaaattaaacttcacagagtttaactgagcaaagaatgatctgtgaatctggcatctggcagcctccttagccagagtaagctcagagagactccagtgcagccacgtggtggaagatttacggtcacaaaaaggaaagtgacatacagaaaatggaagtgaggtacacaaacagccagattggttacagctcaacatttgccttatttgaacatgttttgaacagttggctgcctctgactggccaaaacttggtgactggcacaagagtaggttactgtctatttaaacttccattgaggttactgttcactatgtacagagaaatctttatgccaaacttaaagtatgtaaggaagcaactttaggataaacttgatttaacaatattacatgtgaatatgtgtatatacacatgtgtctttgtgaatataaatataaatctatctatatatattctctaagatattggcacttctaataaagtggttattaaataatatttaaagataaaaacaatgaatttgattagtttagaaagcagagaaagttaacagagcaattctaacacaaatatagttgcttatcattttcagtgtgaaattagagtcaacaaacccatgattttcttagtattcactcactctatatctgtgtacaagtaattggcttattatattaaagttgctttttacttcattttatgttaactctaaaaaactgttaattgtggagtttttaaatgttgttcaatttcttttcattttaataataatattgttaatgttatcattgcttctattttctatgtgcctaacatttctctagagttgagcaggccttatcttccactttatagtgacagtaaattcatttgtgaatggggaagattttcatttatgcagatgggcttgagatagacaaatagatactcaaagagaacaacagagaaatacacaagaatatacacaatatttatactaatttatcatctatttacagaatgatagacattgccattgagttcatatgctagatacattgagtttatctatttatatatcatttaaaaaacagaatggaaatcttcctatatacagtaaacctttccctgccctctaaatcaggatattccacccataatttgcttatctcattgtgctctaatacattgacactcacagaatataggacagttgtatctacattagatggttccagttagtgatgctaatgttcttgttcagcttttcataggtgtttatttcttcaactttagagacagagttcaagatattagtcatttcttgctgctattctctgccagataagtcaatgtagtacaatgtgagagtctaggctttgcatccagatagacctgagattaaatcctgatcaactctttactagttatatggcttgtctgactgtaaagtggagatgataatatccacctccataaggttcttcttataggtgatgacagtacaaatatacagtactggccacctatcgggctttcttttttttttttttttttgagacggagtctcgctctgtcacccaggctggagtgcagtgccgcgatctcggctcactgcaagctccgcctcccaggttcacacccttctcctgcctcagcctcccgagtagctgggattacagaagcccgccaccacgcccagctaattttttgtatttttagtagagacagggtttcaccgtgttagccaggatggtctcgatctcctgacctcgtgatccgcccacctcggcctcccaaagttgggctttcaatagatatgtgtctcttgccactaccctctacaacacccacaacacccaacacccacccacattcatccccttttcatgctttccttcctgtcatctgtgaactgggcaactacataacgaagaagatttgaattatatctaaaccaaaatccagttattataatagaagtatttatttattctgagtgtacactattaattagcaaaacaaagaacataagcctaaaggctaacctatttggacctttaggtgggtaatatttgagatggtccttgaaagttgataggatttagactgaaagacatatgtagagaagcattctgtacagaggaaactgtttcaggcctaaagcacagcatagaacaaggaatgattcaatttatctggaatatagggtgtatgtggtagaagataaaactcaagaatgaatataggcctgttttgtcaaggattctgagcaccaggttaagaagtttaatttgatggaaaataggagttactgatatttcctaagcaaaggacttttgttttaggaggatttctctgtgttagcatttgggatatattagtgctgggagaaacaaaagtgaggaggtcatttagaaagttattagagtggttcaagcaaaaagtaacaaagactaactctcacacattactagtggtaatgtaagtcagtacaatctctatgacaggcaacttggcaatctctaccaacattacaaacgcacataccattttccttagccattccacttctaagaatttatcctcagatatattttcgaatgagtgaagtgatgcatataccaagttattcataatagcataaaaccttaataagaacttgaataacttacagcacattcacagtaacagaattacagcatatatatatataataagaatggggaagtcccttatgtactgattaaaacaatctctaagatgtattaaatttttaaaaattaatatattaaattgtgtaccatttgcttccatctgtgttttaaaaataaaagaaaattctggaagaatacacacacacacacacacacacacacacacacacacacacacacaaattatatctgtggcttcttgttgaatccaaaataaatattaaaagaaataaggcctaaagtcaaagtggtacctataatattggagagataacttattagaagttgatagtgggggaaaatttataaagaaagaatatggacttagaagaacagaaatttgtagaaagcctagtattgaatagtattatgccatgttatggcatgaagcagatgagtgtagatttgcgtgctttaagcagaaagaaaatttaagaaatcatgtttgcagaatataattgtcatcccaattttgccaaacaggcaccaaaatgcttggagatttattgtttcacccaaagtcacacaagtgatgacacagtaaaaacaaaaaacttctttcaaagttttatctaaagctccaatggcatagatatttagacaagtatagacaattgccttcacagctggaagtgccctcttcctccctcaccagttacccatgtaccttccctaacaaggtgaattttcttattcagcaggaaatattccctagacattagtgtttaatgaaaccatttattaaaatccgtgtaattctttcaaaattctaacatatccgaggcttgcctgattctgataataatattcaagcaaagatttttagaaaattttctttaagtcagtatgaaattttgacatttagtcaagattgaatctatggttcagatttcataacctcattaagtctccttgtgcctcttatgtgcagttctgggtacttactattatgtggaagggttaacatttttagaaaggaaacatttataaaccctagttctttttaacaagctgatttagctagttcctaagataatttactttcagaaagtataaccctttactacataacagtattaacttatagattgatttatctatcaataagttatttaagggagttataatttaaagcaataacaaaaaataatacaccaaatgtgaatctaccactgcaaaatttttaatagatacatggtttagttacagtctttta

SEQ ID NO: 128 - DNA, 13876 bp, Homo sapiens
aaacaactccacctcaaacacgagtgtggcattggggagatctttggaggactgcctgctgcaccgaaggcatattctggtttgcaggtgatatggcacacctcccctgccttcatggctgctatggcaatgtcccaagccttgttgacctccccttttcccaggtcaaaggagaatttgtccttgtgatccagactggggtcaaagtttgtgccatctaacagccagccagtgtagtggacaaagattcagtccccaatcatgggcatctctgtacctgtgccctctctcgatgaccttcagcatgccttcctcctgtttgggcgaatgtccactccctccatgggaagaggcgccaactgtgtcccattctcagtctccttcatctcctcaactgtcatctccacgcagcgcaccctttctgggagctggcaccggcaccagcatactctgagccaaaggcaggggtgctaccttcagggtgtgcaggaggccaggtgctgtggtgctgactgcggaccacatggaggctggagcacctctgccagtctgtagtatgatttgaagtcaggtaatgtgattctctccagttttgttctttttgctcaggatagctttgactattctggatcttttgttgtaccatgtaaattttaggatagttttttattattaatatttctgtgaagaatgtcattggtattttgaaagggactgcaatgaatatgtagattgctttgggtgatattgacattttaacaaaattgattcttcccatccatgaacatggaatgtatttctcttttttggtgtcctcttcaatctcttttatcagtgttttatagttttcattgtagagatcatttctttggttaaatcctaggtgatatggtttggctgtgtccctacccaaatctcaccttgaattgtaatagtctccacttgtcaagggtggggccaggtggagataattgtataatgggggcagttcccccatactgttctcatggtagtgaataagtctcatgggatctaatagttttataaatgggagttcccctgtacaagctctcttgcctgccaccatgtaagacatgcctttgcttcttctttgccttctgccatgattgtgaggccttcccagccttgtggaactgtatgtccattaaacctttttcctttataatttacccagtctggggtatgactttattagctgcatgagaacagactaatatgctacatatctaattttatttgtggctattataattaggattactttcttgatttctttttcacactgttcactattagcatatacaaatgctactgatttttgtatgttggttttgtatcctgcaactttacaaaatttatcagttctaatagttttttggtggcgtctttgggttttcccaaatataagataccatctgcaaacaaggataacgtgacttcttcctttccagttggatgccctttatttcttcctcttgtctgattgctgtagctaggacttctagtactatgttgaataacagtggtgaaagtgggcatccttgtcatgatccagatgggagagggaaggttttcaggttttccccattcagtatggttttagctatgggtctgtcacatatggttttaattatgttaaggtatgctccttctatacgcagttttttgagggtttttcatgaagggatgttgaattgtatcaaatgcttttttaacatctactgacatgatcatacggatttgtccatcattctactgatatgatgtatcacattgattgatttgtgtatgttggaacatccttgcaagccagagataaatcccacttggtcatgatgaatgaccttttttaccatattagtgaatttggtttgctaataccttgttgaggccttttgcatcaagattcatcagagatactggcctgtagttttctttttttgatgtgtctatgtctggttttggtatcagagtaatactggcttcatagtatgtgctgggaagtagtccctcctcctctattttttcagaattgtttcagtaggattgctattagttattttttaaatgtttagcataattcagtattgaagtcattgggtcctgggcttttatttacagggagatttttaattacaacttcaatcatgttacttgttattggtctgttcaagttttggatttcttcatggttcaatcttggtaggttgtatgcatctaggaatttgcccatttcttctagattttccaattttttggcatacagttgctcacagtagccagaaattatcatatgaatttctgcattatcagttataatatctcctttttcatctctgattttacatatttggatcttctttttttttcttaggcaagctaaaagtttctcaattttctttatctttaaaaaaacttttcgattcattgatcttttgtattgtcttcttcatttcaatttgatttatttctgctctgatctttattattccttttcttctactaattttggatttggtttgctcttgcttttctacttctttgaggtgcatcattaggttgtttatttgaagttttttttttttttaatgtaggcacttatagctataagcttccctattagtactgcttttgctgtattccatacaacaaaatggtatgttgtgtttccattatcattttttccaagaaatttttcaatttccatcttaatttcttcatttacccactggttgttcaggggcatattgtttactttccatgtgtttgtatagttttcaaaattcctcttgttattgatttctagttttattccattgtggtcagagaatgtgcttgatatgattaacatttttttgaatgttttaagacttgttttgtgacctaacatatgatctgtccttcagaataatctatatgctggggaaaagaatgtgtattctgcagtctttgaaggaaatgttctgtaactatctattagatgtttctttgttgattttctgtctagaagattgatgcagtgttgaaagtgggatgttgaaatctccagctattattatattggggtctacttctctctttagctctaataatattttctttatacatctaggtgctccagcattcagtgcatatatatttaaaatcgttatatcctcttgctgaattgaaccccttatcattatatagtgaccttctttgtctattcttacagtttttgtcttgaaatctattttgtctgatatgaatatagctgcttctgctcttttttggtttccatggacttggaatatcttttccatccctttattttccatgtgtgttttataggtgaagtctgtttcttgtgggcaacagatcattgggtctcagtttttggggggttttttggtgtgttttgttttgttttttgtttattttttggcttttggctttttttttttttttgagatggagtctcactctgtcaccaggctggagtacggtggcacgatctcggcttgctgcaacctccgcctcctggattcaagcaattctcctgcctcagcctcctgagtagctgagactacagacacacaccaccacgcccagctaatttttgtatttttagtagagacagggtttcaccatgttggccaggatggtcttgatctcttgaccaagtgatatgcccacctcagcctcccaaagtgctgggattacaggcgtgagccaccacacctggcctcattgtttttttattccttcagctactctgtgtcctttgaagaactgtgtccatttacattcaatttatagataagtaaggacttacccctgccattttgtgatttgttttctggctgttttgtggtcttctcttccttctttctttccttcatgtctttctttttgcgaaggtaattttcattggtgatatgatttagttagttgctttttattttttgtgtctccattgtatgttttttgatttgagggtatcatgaagcttgcaaatactacgttataacccattattttaagctgataataacactgtttgcataaacaaactaacaaaaagaaaatttacaaagacttcctgcattaactttgtgcccctgctttaagtttttgttactatttatatcttattgtaatatgtcttgaaaagttgttgtagttactatgtttgattggtaagtcatttaatctttctccttaaataacagtagtttacacaccacatttacagtgctataatattctgtttttctgcagactattactagtggattttgtaccttcaggtgattatttattgctcattaatgtccttttctttcttattaaagtactccctttagcatttcttgtaaaaaaaaaagtctgatgttgatgaaatccctcaactttttttttgtctaggaaagtctttattttttcttcattcttgaaggatattttcaccagatatactattctagcataaaagttctcttcccttcagcactttaaatatttcattccactctctcttggcctgtaaggtttccactgaaaaggctgccactagatgtgttggagctccattatttgtttcttttctcttgctgctttttggaacctttttttatccttgacctttgcaagttgaattaccagatgccttgagttagtcttctttgcatgaaatctgcttggtgttctgtaaccttcttgtacttggatactgatatctttctctaggtttaggaagctctctgttattatccctttgaataaagtttctatgcatatctctttctctacatactctttaaagccaataactcttagatttgcccttttgaggctattttctagatcctgtaggcatgcttcatggttttttattctttttgcttttgtctcctctgactgtattttcaaatagcctgttttcaagcttgctgattcttttttctgcttgatcaactctgctattgaacgagtctgatgatttcttcagcatgccagctgcatttttcaactccagaatttctgcatgatcctttttaattattttaatctctttgtcaaattcatctgatagaatcctgaatttcttctctgtgttatcttgaatttctttgggtttcctcaaacagctattttgagttctctgtctgaaaggtcacatatccctgtttctccaggcttggtttctggtgccttatttagtttattcattgaagtcatgttttcctggattgtctggatacttgtaggtgttcatttgtgtctggccattgaagagttaggtatttattgtagtctttgcagtctgggctctttatacccattcttcctgggaaggctttccagatattcaaaaggacttgggtgttatgatctaagctatatctgctttagagaggacccccaagaccagtaacactatgattcttgcagactcatagaggtactgccttgatagtcttggacaagatccagaagaattatctggattaccggagactctggttctcttcctttactttgtcccagtctctctctgtgctgagccacctggagctagaggtggaatgacacaagcacccctgtagccatcacccctagaactgtgctgggtcagacctgaaaccagcagagcactgggtcttgcccaagccctgctgtaaccactctttggctaccagctatgttcattcaaggccctgaagatctgcaattagctggtgacagagccagccaggcctatgttcttcccttgagggtgatgagtttctccaagcccaagctccaggagggtccagaggtgccattcaggagccagaaactagagtcaaaaatcttagaagtctacctggtgttctattgtactgtggctaagctggcactcaaaccacaagacgcagcgcttcccatgcttccctcccctttccaaatgcagcgagcctcacctcatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctacccagctgtagggcctaccttatataaactttttatccaggatagctttcttttttgtctttgggacagtattgtaactaagcaaaaagataagcggatttaatttttcttattagtcatttaagatttttatttgccttttataaggagtctttaatttaaaatactgaaatactttagaagcttctgcatatcagtaggcatccatagatgagagtaatttggaaagcttcattttcttttctttttttttaatttcaacttttattttaaatacagggtacatgtacagatttgttacataggaatattgtatgatgctgaagtttggagtacaggttccctcaccctggtagtaagcataatatagtactcaataggtagtttttcaacccacccactcccaagctcgagtagtccacagtgtctatcgttctaatatttatgtccatgtgttctcaatgcttagctcccaattagaaggaagaacatgcagttttgaattttctgtttctgcattaatttgctgaggattatggcctccagctccatccatgttgctgcaaaggccatgatttcatttttttataactgtgtactattccgtggtgtgtatatacagcattttctttattcaatccaccactgatgggcagctaggttgatcccatgtctttgctagtgtgaatagtgcaacaatgaacagaaaagtgcatgtgtctttttggtagaatgatttattttcttctgggtgtaaacctagtaatggtatggctgagatgaatggtagccctgttttaggttctttgagaaatctccagattgctttccacagtggctaaactaatttaaattcccactaacaatgtataagtgtccacttttctccacatcttcaccagcatctgttgttttttggatttttagtaacagccattctgactggtgtgagattttatctcactgtcagtttgatttgcatttctctgatgattagtgatgctgagcattttttcatgtttgttggtgacttgtatgacgtcttttgagaagtatgtgttcatgtcctttgcccattttttaatgaagttatttggtgttttgcctgttgatttgttcaagctccctatagattctggatactaggccattgttggatgcatagtttgcagatatcgtctctcattctgcaggttgtctgtttgctttgttcatagtttcttttgttgtgcagaagctttttagtttaattagatcctttttgtcttgttgttgttgttgttgcaatggcttttcatacttagctaaaaattttttaccaaggctgactttgagataagtatttcctaggttgtcttccaggatctttacagtttgaggaccttcattgaaatctttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcagattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatagtgtagccttgaagttgggtaatgtgatacctctggcttcattcttttgcttaggatagctttggctattggggctctttttcagttccatatttattttagaatcatttgttctgtgaaaaatggctttggtagtttgataggaatagtgttgaatctttaacttgctttggacagtatggccatttttacgaaactgattcttccaattcatcggcatggaatgtttccccatttatgtcatctctgatctccttctgcaatgttttgtagttctctttgtagagatctttcacctccttggctacctgtattcctagatatttcattttcttttggctattgtaaatgggattatgttcttgatttcactctcagcctggactttgttggcatatagaaaatgctactgatttttatacaatgattttgtaacctgaaactttactaaaggtgtttatctattctaggagactattggcaaagtctttaggattttctaggtatagaattatgttatcagcaaacagggagagtttgacttcctttcctatttggatgccttttatttctttctcttgcctgattgttccagctatgacttccagtactgtgttgaacatgagtggtaagagtgtgcatcttggttctgttccagttctcaaagggaatgcttcaagctattgtccacttagtatgatgttggctgtgggtttgtcatagatggctcttattattttgaagtatgttccttcattgcctagtctgttgagggtttttaacatgaagggatgttggatttcatcaaaagctttttctgcatctattgagaagataatttcatttttgcttttgattctgcttatgtagtgaatcacatttattcatttgcatatgttgaaccagccttgcattccaggaataaagcttacttgatcatgttttactaacttttcaatatgctgctggatttgattttctagtattttgttgaggattttcaggtctatattcatgagagatattggtctaaagtttcctttattaattgtgtctctgccagatttgggtaccaggctgatgctggcttcatagaatatattagaaaggaacccctcctctttgattttttgaataatttcagtaggattggtatcagttctttgtatgtctggtagaattcagctgtgaatccatctgagccagggctttttttggttagtaggttcttaattactgattcaatttcagaagtcgatagtggtctattcaggttttcaatctcttcctgattcagtcttggaagattgtgtccttccaggaatttacctacttcctctagattttctaatttgtgtgcatagggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggtagaacacaaaaatccctataaatttccaaaaccaaagtttgcatcccctgaaatattgccattttctactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggatcccacttctgacaccatctgtttaaaaaaaaaaaaaagccttagacaaattaaacttcacagagtttaactgagcaaagaatgatctgtgaatctggcatctggcagcctccttagccagagtaagctcagagagactccagtgcagccacgtggtggaagatttacggtcacaaaaaggaaagtgacatacagaaaatggaagtgaggtacacaaacagccagattggttacagctcaacatttgccttatttgaacatgttttgaacagttggctgcctctgactggccaaaacttggtgactggcacaagagtaggttactgtctatttaaacttccattgaggttactgttcactatgtacagagaaatctttatgccaaacttaaagtatgtaaggaagcaactttaggataaacttgatttaacaatattacatgtgaatatgtgtatatacacatgtgtctttgtgaatataaatataaatctatctatatatattctctaagatattggcacttctaataaagtggttattaaataatatttaaagataaaaacaatgaatttgattagtttagaaagcagagaaagttaacagagcaattctaacacaaatatagttgcttatcattttcagtgtgaaattagagtcaacaaacccatgattttcttagtattcactcactctatatctgtgtacaagtaattggcttattatattaaagttgctttttacttcattttatgttaactctaaaaaactgttaattgtggagtttttaaatgttgttcaatttcttttcattttaataataatattgttaatgttatcattgcttctattttctatgtgcctaacatttctctagagttgagcaggccttatcttccactttatagtgacagtaaattcatttgtgaatggggaagattttcatttatgcagatgggcttgagatagacaaatagatactcaaagagaacaacagagaaatacacaagaatatacacaatatttatactaatttatcatctatttacagaatgatagacattgccattgagttcatatgctagatacattgagtttatctatttatatatcatttaaaaaacagaatggaaatcttcctatatacagtaaacctttccctgccctctaaatcaggatattccacccataatttgcttatctcattgtgctctaatacattgacactcacagaatataggacagttgtatctacattagatggttccagttagtgatgctaatgttcttgttcagcttttcataggtgtttatttcttcaactttagagacagagttcaagatattagtcatttcttgctgctattctctgccagataagtcaatgtagtacaatgtgagagtctaggctttgcatccagatagacctgagattaaatcctgatcaactctttactagttatatggcttgtctgactgtaaagtggagatgataatatccacctccataaggttcttcttataggtgatgacagtacaaatatacagtactggccacctatcgggctttcttttttttttttttttttgagacggagtctcgctctgtcacccaggctggagtgcagtgccgcgatctcggctcactgcaagctccgcctcccaggttcacacccttctcctgcctcagcctcccgagtagctgggattacagaagcccgccaccacgcccagctaattttttgtatttttagtagagacagggtttcaccgtgttagccaggatggtctcgatctcctgacctcgtgatccgcccacctcggcctcccaaagttgggctttcaatagatatgtgtctcttgccactaccctctacaacacccacaacacccaacacccacccacattcatccccttttcatgctttccttcctgtcatctgtgaactgggcaactacataacgaagaagatttgaattatatctaaaccaaaatccagttattataatagaagtatttatttattctgagtgtacactattaattagcaaaacaaagaacataagcctaaaggctaacctatttggacctttaggtgggtaatatttgagatggtccttgaaagttgataggatttagactgaaagacatatgtagagaagcattctgtacagaggaaactgtttcaggcctaaagcacagcatagaacaaggaatgattcaatttatctggaatatagggtgtatgtggtagaagataaaactcaagaatgaatataggcctgttttgtcaaggattctgagcaccaggttaagaagtttaatttgatggaaaataggagttactgatatttcctaagcaaaggacttttgttttaggaggatttctctgtgttagcatttgggatatattagtgctgggagaaacaaaagtgaggaggtcatttagaaagttattagagtggttcaagcaaaaagtaacaaagactaactctcacacattactagtggtaatgtaagtcagtacaatctctatgacaggcaacttggcaatctctaccaacattacaaacgcacataccattttccttagccattccacttctaagaatttatcctcagatatattttcgaatgagtgaagtgatgcatataccaagttattcataatagcataaaaccttaataagaacttgaataacttacagcacattcacagtaacagaattacagcatatatatatataataagaatggggaagtcccttatgtactgattaaaacaatctctaagatgtattaaatttttaaaaattaatatattaaattgtgtaccatttgcttccatctgtgttttaaaaataaaagaaaattctggaagaatacacacacacacacacacacacacacacacacacacacacacacaaattatatctgtggcttcttgttgaatccaaaataaatattaaaagaaataaggcctaaagtcaaagtggtacctataatattggagagataacttattagaagttgatagtgggggaaaatttataaagaaagaatatggacttagaagaacagaaatttgtagaaagcctagtattgaatagtattatgccatgttatggcatgaagcagatgagtgtagatttgcgtgctttaagcagaaagaaaatttaagaaatcatgtttgcagaatataattgtcatcccaattttgccaaacaggcaccaaaatgcttggagatttattgtttcacccaaagtcacacaagtgatgacacagtaaaaacaaaaaacttctttcaaagttttatctaaagctccaatggcatagatatttagacaagtatagacaattgccttcacagctggaagtgccctcttcctccctcaccagttacccatgtaccttccctaacaaggtgaattttcttattcagcaggaaatattccctagacattagtgtttaatgaaaccatttattaaaatccgtgtaattctttcaaaattctaacatatccgaggcttgcctgattctgataataatattcaagcaaagatttttagaaaattttctttaagtcagtatgaaattttgacatttagtcaagattgaatctatggttcagatttcataacctcattaagtctccttgtgcctcttatgtgcagttctgggtacttactattatgtggaagggttaacatttttagaaaggaaacatttataaaccctagttctttttaacaagctgatttagctagttcctaagataatttactttcagaaagtataaccctttactacataacagtattaacttatagattgatttatctatcaataagttatttaagggagttataatttaaagcaataacaaaaaataatacaccaaatgtgaatctaccactgcaaaatttttaatagatacatggtttagttacagtctttta

SEQ ID NO: 129 - DNA, 15129 bp, Homo sapiens
tacccctggaaaatggacctaacaaacagaaggagcaaaataaattaacactctaatgagcatgtatggatggacatatgttcatgtgcaatgggggaagggaagagggggtgacaccacctaaaatgattccccacctcaatctcccagcctactcctttcccccttccccctaaagccaccatccaaccagatagaaaaataaaggtctaattcactcaaaattcttcagtttttacaaaactaacagggcagagtagggagacggggggcaggcagccacaggagtagggctggtggagaggggctatgcttctgtctccacttgagactggctctctgtggtgttgctcttctgctcctccatctctgtgtcagtgagattgtctcctgaggaagcctctgccttggccttgttctcttcctcagccagcctctcaaacgtgttggcgtagagcgtcttctcccaggcaagctgcctgcagatctgctgctggcacacagccagctgggccttggcggcttcgttgttggggtagagctgcaagaccttctggaagtcagcctgtgccagttcaaagtcattcacagccaggtgggcctctccccaatggaagaggcccttctcgttgttgctgcccagttccagggccttgttacagctttcagtggcagcagagaaggcctgtagtttcagatgacacatggccaggttgaggtaagaggccagttgaagggcctgtgccttctgtgtttcctcattggaaaaactagactcatattctacccaggacacaatcctcttatattatagtaaagcttgcttgtatttgccttccttgaagtacacagtgtcccactctttcactgtggtgctctgctccagcttctcttctgaattcatctcccaagactccttggtcttttcaaaactcttgaggtgtaattcatatttcagctaggcatttggtgggatttggaacttttccttcctaacactgccaaaagcatagctgggtttgaggtacacaatggaatgttctcctttctacatgcactgaatggccctctccagaccataaggcagatccagattctcctgatgttcaaagaactagtccttgtagcacccttccagtgcaatctccatgatagcaccctcattgggcctgggatagccttcaccgcaagtctgtaattctgtagatgattccgccatcttcttcttccgtcagatcttctcccttaaactcaaacaactccacctcaaacacgagtgtggcattggggagatctttggaggactgcctgctgcaccgaaggcatattctggtttgcaggtgatatggcacacctcccctgccttcatggctgctatggcaatgtcccaagccttgttgacctccccttttcccaggtcaaaggagaatttgtccttgtgatccagactggggtcaaagtttgtgccatctaacagccagccagtgtagtggacaaagattcagtccccaatcatgggcatctctgtacctgtgccctctctcgatgaccttcagcatgccttcctcctgtttgggcgaatgtccactccctccatgggaagaggcgccaactgtgtcccattctcagtctccttcatctcctcaactgtcatctccacgcagcgcaccctttctgggagctggcaccggcaccagcatactctgagccaaaggcaggggtgctaccttcagggtgtgcaggaggccaggtgctgtggtgctgactgcggaccacatggaggctggagcacctctgccagtctgtagtatgatttgaagtcaggtaatgtgattctctccagttttgttctttttgctcaggatagctttgactattctggatcttttgttgtaccatgtaaattttaggatagttttttattattaatatttctgtgaagaatgtcattggtattttgaaagggactgcaatgaatatgtagattgctttgggtgatattgacattttaacaaaattgattcttcccatccatgaacatggaatgtatttctcttttttggtgtcctcttcaatctcttttatcagtgttttatagttttcattgtagagatcatttctttggttaaatcctaggtgatatggtttggctgtgtccctacccaaatctcaccttgaattgtaatagtctccacttgtcaagggtggggccaggtggagataattgtataatgggggcagttcccccatactgttctcatggtagtgaataagtctcatgggatctaatagttttataaatgggagttcccctgtacaagctctcttgcctgccaccatgtaagacatgcctttgcttcttctttgccttctgccatgattgtgaggccttcccagccttgtggaactgtatgtccattaaacctttttcctttataatttacccagtctggggtatgactttattagctgcatgagaacagactaatatgctacatatctaattttatttgtggctattataattaggattactttcttgatttctttttcacactgttcactattagcatatacaaatgctactgatttttgtatgttggttttgtatcctgcaactttacaaaatttatcagttctaatagttttttggtggcgtctttgggttttcccaaatataagataccatctgcaaacaaggataacgtgacttcttcctttccagttggatgccctttatttcttcctcttgtctgattgctgtagctaggacttctagtactatgttgaataacagtggtgaaagtgggcatccttgtcatgatccagatgggagagggaaggttttcaggttttccccattcagtatggttttagctatgggtctgtcacatatggttttaattatgttaaggtatgctccttctatacgcagttttttgagggtttttcatgaagggatgttgaattgtatcaaatgcttttttaacatctactgacatgatcatacggatttgtccatcattctactgatatgatgtatcacattgattgatttgtgtatgttggaacatccttgcaagccagagataaatcccacttggtcatgatgaatgaccttttttaccatattagtgaatttggtttgctaataccttgttgaggccttttgcatcaagattcatcagagatactggcctgtagttttctttttttgatgtgtctatgtctggttttggtatcagagtaatactggcttcatagtatgtgctgggaagtagtccctcctcctctattttttcagaattgtttcagtaggattgctattagttattttttaaatgtttagcataattcagtattgaagtcattgggtcctgggcttttatttacagggagatttttaattacaacttcaatcatgttacttgttattggtctgttcaagttttggatttcttcatggttcaatcttggtaggttgtatgcatctaggaatttgcccatttcttctagattttccaattttttggcatacagttgctcacagtagccagaaattatcatatgaatttctgcattatcagttataatatctcctttttcatctctgattttacatatttggatcttctttttttttcttaggcaagctaaaagtttctcaattttctttatctttaaaaaaacttttcgattcattgatcttttgtattgtcttcttcatttcaatttgatttatttctgctctgatctttattattccttttcttctactaattttggatttggtttgctcttgcttttctacttctttgaggtgcatcattaggttgtttatttgaagttttttttttttttaatgtaggcacttatagctataagcttccctattagtactgcttttgctgtattccatacaacaaaatggtatgttgtgtttccattatcattttttccaagaaatttttcaatttccatcttaatttcttcatttacccactggttgttcaggggcatattgtttactttccatgtgtttgtatagttttcaaaattcctcttgttattgatttctagttttattccattgtggtcagagaatgtgcttgatatgattaacatttttttgaatgttttaagacttgttttgtgacctaacatatgatctgtccttcagaataatctatatgctggggaaaagaatgtgtattctgcagtctttgaaggaaatgttctgtaactatctattagatgtttctttgttgattttctgtctagaagattgatgcagtgttgaaagtgggatgttgaaatctccagctattattatattggggtctacttctctctttagctctaataatattttctttatacatctaggtgctccagcattcagtgcatatatatttaaaatcgttatatcctcttgctgaattgaaccccttatcattatatagtgaccttctttgtctattcttacagtttttgtcttgaaatctattttgtctgatatgaatatagctgcttctgctcttttttggtttccatggacttggaatatcttttccatccctttattttccatgtgtgttttataggtgaagtctgtttcttgtgggcaacagatcattgggtctcagtttttggggggttttttggtgtgttttgttttgttttttgtttattttttggcttttggctttttttttttttttgagatggagtctcactctgtcaccaggctggagtacggtggcacgatctcggcttgctgcaacctccgcctcctggattcaagcaattctcctgcctcagcctcctgagtagctgagactacagacacacaccaccacgcccagctaatttttgtatttttagtagagacagggtttcaccatgttggccaggatggtcttgatctcttgaccaagtgatatgcccacctcagcctcccaaagtgctgggattacaggcgtgagccaccacacctggcctcattgtttttttattccttcagctactctgtgtcctttgaagaactgtgtccatttacattcaatttatagataagtaaggacttacccctgccattttgtgatttgttttctggctgttttgtggtcttctcttccttctttctttccttcatgtctttctttttgcgaaggtaattttcattggtgatatgatttagttagttgctttttattttttgtgtctccattgtatgttttttgatttgagggtatcatgaagcttgcaaatactacgttataacccattattttaagctgataataacactgtttgcataaacaaactaacaaaaagaaaatttacaaagacttcctgcattaactttgtgcccctgctttaagtttttgttactatttatatcttattgtaatatgtcttgaaaagttgttgtagttactatgtttgattggtaagtcatttaatctttctccttaaataacagtagtttacacaccacatttacagtgctataatattctgtttttctgcagactattactagtggattttgtaccttcaggtgattatttattgctcattaatgtccttttctttcttattaaagtactccctttagcatttcttgtaaaaaaaaaagtctgatgttgatgaaatccctcaactttttttttgtctaggaaagtctttattttttcttcattcttgaaggatattttcaccagatatactattctagcataaaagttctcttcccttcagcactttaaatatttcattccactctctcttggcctgtaaggtttccactgaaaaggctgccactagatgtgttggagctccattatttgtttcttttctcttgctgctttttggaacctttttttatccttgacctttgcaagttgaattaccagatgccttgagttagtcttctttgcatgaaatctgcttggtgttctgtaaccttcttgtacttggatactgatatctttctctaggtttaggaagctctctgttattatccctttgaataaagtttctatgcatatctctttctctacatactctttaaagccaataactcttagatttgcccttttgaggctattttctagatcctgtaggcatgcttcatggttttttattctttttgcttttgtctcctctgactgtattttcaaatagcctgttttcaagcttgctgattcttttttctgcttgatcaactctgctattgaacgagtctgatgatttcttcagcatgccagctgcatttttcaactccagaatttctgcatgatcctttttaattattttaatctctttgtcaaattcatctgatagaatcctgaatttcttctctgtgttatcttgaatttctttgggtttcctcaaacagctattttgagttctctgtctgaaaggtcacatatccctgtttctccaggcttggtttctggtgccttatttagtttattcattgaagtcatgttttcctggattgtctggatacttgtaggtgttcatttgtgtctggccattgaagagttaggtatttattgtagtctttgcagtctgggctctttatacccattcttcctgggaaggctttccagatattcaaaaggacttgggtgttatgatctaagctatatctgctttagagaggacccccaagaccagtaacactatgattcttgcagactcatagaggtactgccttgatagtcttggacaagatccagaagaattatctggattaccggagactctggttctcttcctttactttgtcccagtctctctctgtgctgagccacctggagctagaggtggaatgacacaagcacccctgtagccatcacccctagaactgtgctgggtcagacctgaaaccagcagagcactgggtcttgcccaagccctgctgtaaccactctttggctaccagctatgttcattcaaggccctgaagatctgcaattagctggtgacagagccagccaggcctatgttcttcccttgagggtgatgagtttctccaagcccaagctccaggagggtccagaggtgccattcaggagccagaaactagagtcaaaaatcttagaagtctacctggtgttctattgtactgtggctaagctggcactcaaaccacaagacgcagcgcttcccatgcttccctcccctttccaaatgcagcgagcctcacctcatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctacccagctgtagggcctaccttatataaactttttatccaggatagctttcttttttgtctttgggacagtattgtaactaagcaaaaagataagcggatttaatttttcttattagtcatttaagatttttatttgccttttataaggagtctttaatttaaaatactgaaatactttagaagcttctgcatatcagtaggcatccatagatgagagtaatttggaaagcttcattttcttttctttttttttaatttcaacttttattttaaatacagggtacatgtacagatttgttacataggaatattgtatgatgctgaagtttggagtacaggttccctcaccctggtagtaagcataatatagtactcaataggtagtttttcaacccacccactcccaagctcgagtagtccacagtgtctatcgttctaatatttatgtccatgtgttctcaatgcttagctcccaattagaaggaagaacatgcagttttgaattttctgtttctgcattaatttgctgaggattatggcctccagctccatccatgttgctgcaaaggccatgatttcatttttttataactgtgtactattccgtggtgtgtatatacagcattttctttattcaatccaccactgatgggcagctaggttgatcccatgtctttgctagtgtgaatagtgcaacaatgaacagaaaagtgcatgtgtctttttggtagaatgatttattttcttctgggtgtaaacctagtaatggtatggctgagatgaatggtagccctgttttaggttctttgagaaatctccagattgctttccacagtggctaaactaatttaaattcccactaacaatgtataagtgtccacttttctccacatcttcaccagcatctgttgttttttggatttttagtaacagccattctgactggtgtgagattttatctcactgtcagtttgatttgcatttctctgatgattagtgatgctgagcattttttcatgtttgttggtgacttgtatgacgtcttttgagaagtatgtgttcatgtcctttgcccattttttaatgaagttatttggtgttttgcctgttgatttgttcaagctccctatagattctggatactaggccattgttggatgcatagtttgcagatatcgtctctcattctgcaggttgtctgtttgctttgttcatagtttcttttgttgtgcagaagctttttagtttaattagatcctttttgtcttgttgttgttgttgttgcaatggcttttcatacttagctaaaaattttttaccaaggctgactttgagataagtatttcctaggttgtcttccaggatctttacagtttgaggaccttcattgaaatctttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcagattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatagtgtagccttgaagttgggtaatgtgatacctctggcttcattcttttgcttaggatagctttggctattggggctctttttcagttccatatttattttagaatcatttgttctgtgaaaaatggctttggtagtttgataggaatagtgttgaatctttaacttgctttggacagtatggccatttttacgaaactgattcttccaattcatcggcatggaatgtttccccatttatgtcatctctgatctccttctgcaatgttttgtagttctctttgtagagatctttcacctccttggctacctgtattcctagatatttcattttcttttggctattgtaaatgggattatgttcttgatttcactctcagcctggactttgttggcatatagaaaatgctactgatttttatacaatgattttgtaacctgaaactttactaaaggtgtttatctattctaggagactattggcaaagtctttaggattttctaggtatagaattatgttatcagcaaacagggagagtttgacttcctttcctatttggatgccttttatttctttctcttgcctgattgttccagctatgacttccagtactgtgttgaacatgagtggtaagagtgtgcatcttggttctgttccagttctcaaagggaatgcttcaagctattgtccacttagtatgatgttggctgtgggtttgtcatagatggctcttattattttgaagtatgttccttcattgcctagtctgttgagggtttttaacatgaagggatgttggatttcatcaaaagctttttctgcatctattgagaagataatttcatttttgcttttgattctgcttatgtagtgaatcacatttattcatttgcatatgttgaaccagccttgcattccaggaataaagcttacttgatcatgttttactaacttttcaatatgctgctggatttgattttctagtattttgttgaggattttcaggtctatattcatgagagatattggtctaaagtttcctttattaattgtgtctctgccagatttgggtaccaggctgatgctggcttcatagaatatattagaaaggaacccctcctctttgattttttgaataatttcagtaggattggtatcagttctttgtatgtctggtagaattcagctgtgaatccatctgagccagggctttttttggttagtaggttcttaattactgattcaatttcagaagtcgatagtggtctattcaggttttcaatctcttcctgattcagtcttggaagattgtgtccttccaggaatttacctacttcctctagattttctaatttgtgtgcatagggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggtagaacacaaaaatccctataaatttccaaaaccaaagtttgcatcccctgaaatattgccattttctactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggatcccacttctgacaccatctgtttaaaaaaaaaaaaaagccttagacaaattaaacttcacagagtttaactgagcaaagaatgatctgtgaatctggcatctggcagcctccttagccagagtaagctcagagagactccagtgcagccacgtggtggaagatttacggtcacaaaaaggaaagtgacatacagaaaatggaagtgaggtacacaaacagccagattggttacagctcaacatttgccttatttgaacatgttttgaacagttggctgcctctgactggccaaaacttggtgactggcacaagagtaggttactgtctatttaaacttccattgaggttactgttcactatgtacagagaaatctttatgccaaacttaaagtatgtaaggaagcaactttaggataaacttgatttaacaatattacatgtgaatatgtgtatatacacatgtgtctttgtgaatataaatataaatctatctatatatattctctaagatattggcacttctaataaagtggttattaaataatatttaaagataaaaacaatgaatttgattagtttagaaagcagagaaagttaacagagcaattctaacacaaatatagttgcttatcattttcagtgtgaaattagagtcaacaaacccatgattttcttagtattcactcactctatatctgtgtacaagtaattggcttattatattaaagttgctttttacttcattttatgttaactctaaaaaactgttaattgtggagtttttaaatgttgttcaatttcttttcattttaataataatattgttaatgttatcattgcttctattttctatgtgcctaacatttctctagagttgagcaggccttatcttccactttatagtgacagtaaattcatttgtgaatggggaagattttcatttatgcagatgggcttgagatagacaaatagatactcaaagagaacaacagagaaatacacaagaatatacacaatatttatactaatttatcatctatttacagaatgatagacattgccattgagttcatatgctagatacattgagtttatctatttatatatcatttaaaaaacagaatggaaatcttcctatatacagtaaacctttccctgccctctaaatcaggatattccacccataatttgcttatctcattgtgctctaatacattgacactcacagaatataggacagttgtatctacattagatggttccagttagtgatgctaatgttcttgttcagcttttcataggtgtttatttcttcaactttagagacagagttcaagatattagtcatttcttgctgctattctctgccagataagtcaatgtagtacaatgtgagagtctaggctttgcatccagatagacctgagattaaatcctgatcaactctttactagttatatggcttgtctgactgtaaagtggagatgataatatccacctccataaggttcttcttataggtgatgacagtacaaatatacagtactggccacctatcgggctttcttttttttttttttttttgagacggagtctcgctctgtcacccaggctggagtgcagtgccgcgatctcggctcactgcaagctccgcctcccaggttcacacccttctcctgcctcagcctcccgagtagctgggattacagaagcccgccaccacgcccagctaattttttgtatttttagtagagacagggtttcaccgtgttagccaggatggtctcgatctcctgacctcgtgatccgcccacctcggcctcccaaagttgggctttcaatagatatgtgtctcttgccactaccctctacaacacccacaacacccaacacccacccacattcatccccttttcatgctttccttcctgtcatctgtgaactgggcaactacataacgaagaagatttgaattatatctaaaccaaaatccagttattataatagaagtatttatttattctgagtgtacactattaattagcaaaacaaagaacataagcctaaaggctaacctatttggacctttaggtgggtaatatttgagatggtccttgaaagttgataggatttagactgaaagacatatgtagagaagcattctgtacagaggaaactgtttcaggcctaaagcacagcatagaacaaggaatgattcaatttatctggaatatagggtgtatgtggtagaagataaaactcaagaatgaatataggcctgttttgtcaaggattctgagcaccaggttaagaagtttaatttgatggaaaataggagttactgatatttcctaagcaaaggacttttgttttaggaggatttctctgtgttagcatttgggatatattagtgctgggagaaacaaaagtgaggaggtcatttagaaagttattagagtggttcaagcaaaaagtaacaaagactaactctcacacattactagtggtaatgtaagtcagtacaatctctatgacaggcaacttggcaatctctaccaacattacaaacgcacataccattttccttagccattccacttctaagaatttatcctcagatatattttcgaatgagtgaagtgatgcatataccaagttattcataatagcataaaaccttaataagaacttgaataacttacagcacattcacagtaacagaattacagcatatatatatataataagaatggggaagtcccttatgtactgattaaaacaatctctaagatgtattaaatttttaaaaattaatatattaaattgtgtaccatttgcttccatctgtgttttaaaaataaaagaaaattctggaagaatacacacacacacacacacacacacacacacacacacacacacacaaattatatctgtggcttcttgttgaatccaaaataaatattaaaagaaataaggcctaaagtcaaagtggtacctataatattggagagataacttattagaagttgatagtgggggaaaatttataaagaaagaatatggacttagaagaacagaaatttgtagaaagcctagtattgaatagtattatgccatgttatggcatgaagcagatgagtgtagatttgcgtgctttaagcagaaagaaaatttaagaaatcatgtttgcagaatataattgtcatcccaattttgccaaacaggcaccaaaatgcttggagatttattgtttcacccaaagtcacacaagtgatgacacagtaaaaacaaaaaacttctttcaaagttttatctaaagctccaatggcatagatatttagacaagtatagacaattgccttcacagctggaagtgccctcttcctccctcaccagttacccatgtaccttccctaacaaggtgaattttcttattcagcaggaaatattccctagacattagtgtttaatgaaaccatttattaaaatccgtgtaattctttcaaaattctaacatatccgaggcttgcctgattctgataataatattcaagcaaagatttttagaaaattttctttaagtcagtatgaaattttgacatttagtcaagattgaatctatggttcagatttcataacctcattaagtctccttgtgcctcttatgtgcagttctgggtacttactattatgtggaagggttaacatttttagaaaggaaacatttataaaccctagttctttttaacaagctgatttagctagttcctaagataatttactttcagaaagtataaccctttactacataacagtattaacttatagattgatttatctatcaataagttatttaagggagttataatttaaagcaataacaaaaaataatacaccaaatgtgaatctaccactgcaaaatttttaatagatacatggtttagttacagtctttta

SEQ ID NO: 130 - DNA, 22886 bp, Homo sapiens
tcactttaacaggaaatcaaatgcactggtgtaataaaatttgtgatgataaatgcttgtaaattaaagccaataagtataagataaagtggtatctaataatatgtatattatacatttattataaattatatatattaattttataacatacatatgatatatgtagatatcattaaaagaaaaaccttagacaaattaaatttaacagtttaattgagcaaagaacaatttgcaaatcaggcagcctcttgagccagggtacattcagagagattccagtgcagccacatggttgaagatttatggacagaaaaaggaaagtgatgtacagaacatggaagtggggtacagaaacagccagattggttggttacagttcagcatttgcctaatttggacatggcttgaatagttggctacctttcattggccaaaactcagtgattgacacaagaatgggtttatttatttacatctccatttacattatagttcactatgtatagagaaccctttaggctgcacttaaagtatgtaaggaggcatatgctttatgctaaacttaacaatttcccctctaaaattaagaggatgaccaaaactttagtcattgatgtcactattaccatcataattttacttatttggtcttgaaacccagtgggaaaacagtgggttttataaagtagaaacaagcacttcaggttattttttgggtaacggtcagaggagagggtacctccttgttttggaatcttctgcttacaggagaaaaacaaaatctggtctgttttaggacctatctacttccttaaagtttcagtttgattgtgtcatatttagcatgagtgactccattttagtttggtctggtctgctggggcctactgtacaaactcagtctaaaacaatggctcccataattttctttaaaaaaattcctccattttgattaacttctctgtattagtcagagttctctagagggacagaactaataagatagatgcatataaaaagggaagtttattaagcagtattaatgcacacgatcacaaggtctcacaataggccgtctgcaagccaaggagcaaggaagccagtttgagtcccaaagctgaaggacttggagtctaatgttcgaggacaggaggcgtccagcacagaaaaaaatgtaggctgagaggctaagccagtctgatctctccacgttgttctgcctgcttttattctgatcacattggcagctgattagattgtgcccactcagattaaagtgggtctgcctttcccagcccactgacttaaatgttaatctcctttggcaacaccttcacagacacacccaggatcaatactttgcatccttcaatccagtcaagttgacactcagtattaaccatcacattctcacttaggtaacggtgtgacaaaacttagggccttagtgccacttcagttaccatcattttgggtttctagtttcagcacatcattcataagtcatcatgtcctcatggtcacacatttctttaagcttttgtcattacagttcaggagagaccatttgacattcttgagatggctgcatgcaaacattcaaaactttttaaagaaaacagcacatgagggagactactattatgaccatgaggaggataataccaagagtttggagtatgctttttagccagagtccccatgaaccaatccaactacaattaaatagatcaaagaattagctagacaaagagtctactcatttcaaccaggtagcctgttcattaatcccctagaaatgaatctctataatacccaatgtattccttcacgtacaactagaagtaccagcaactatacagatacttctgtttagccagcaagtaatctagagcaattcaattatttagcataactttcacaagagaattttaagtctgttgtgtagccagagcttttgcagtagaatctgctacagagcctatcatgagggataaatttctaatcattgcctcatctactcccaaccacagaaagagcgatctaacaaatgatatccatccaaaagagagaagatctcctgtaaaggttttctttaatccatgatgtaccttaagaggagtggaccaatgttctgtttttgattgactatgaaggaacaaggctaacatttgttgttcgtattggtccttcatctttcatctctcaaggcataaggttgtccatgtggaagtttggctgcgaaatcttccacaaataaaagtataccccaagagggcacataagagaccccctttttagctctattgttgttagagacataagcaagaaaaaatgagagattaagagtttcataacagcagacaattcttgatccatgatcttgggaaaaagccatccacatcaatgatgccatcttcttggggagaaacctccctggttagctttaccttaagagttccaatgggcatacatttccaagactgtggaatgacccttctcagttgtgagattatgaagccaagactcaagttcccaaagttttgctgcagtgtggatggcaagagcaatctttctctgatgttgctcccagaagacccagtcttcatattctagattattaaggggttgattgtcctcagtcagtggaccataaaaagctttctttaactggtgaaaatacactttggcctaatgagctactgttacaacatcagccctcttgcctaggaaagcttttatacaaccagaaaacatacattgaaaatgaaaattgaatgaaatccctctataaatgtttaaatggcccatcaggtaacagaaatgtacctgaagtttagattatcttcctaggaatatgggtttaacaaaccaaacattgatcataaactattttagcaatttaggacagttacaccacctataaatatcattaatatatgatatatttattatatattattaatatataatatattaataatttatatattaatttggattcctttatcatttccatgatgaatcatggattgtacagcttttaataatgaaaactttaaagactcagaaaagacaaagcagccatctaagttctccctgagtccacatttaacattggacttatgtcctcttaaatccagttgtttctccgatttaggtgcagagcactgataactaataggctatcgcagataatttgacttgcaccatggagtttattcaaattgcatatctaaacagtagtggctgatttagcatgaaaatctgagaaagtattttcttgatattcaattaatttttgtcttgcttgggttagcagttttaaaaaccagtcagtttctcattagatttctgggaattcttatccaggcttcataatatgatccaaaagttatcacaaacctatatccaagagtgcttaccagggtgctttgaatcctttcatgaacctccttaaaaacacagtaccctaagattctatgtgcttgtgaagttttcaaaaactgcatcagaattaagcaattaactgtagaaatgactttaaatggtcatagttaaagacaattgacaaggaaatttggttatttctttgacctataaaataacttcacataataaccataactgtgtagcatatactgagatatattagaattttagaaatctgatataattttagaacatatattaataatatattcattaaaatataacttttttttgagataagtctcactctgttacccagactagagtgcagtgccacaatcttggctcactgcaacctctgcatcccaggctcaagtgaccctcccaccccagcttcccaagtagctgggaccacaggtacacgccagcatgcctggctaagtttttgtatttttagtagagatggggtttgcccatgttgcccaggctggtcttgaactcctgagctcaggtgctctgcctgtctcagcctctcaaagtgctgggattacaggcatgagccacagcatccagccaataacttgaagaaagttaaacatttcttatttgtcactgcttcccatgtaattcaacatgtcaaataatcctatttatgtcttttttggatgtttcaggagccctctgtagcatcccaaaattgaaggtcaaaaaacacaatactgaagctgaaatttgatttggggaagcctgtcaaatatgtcaaaggtttaaaatacttaacacaaatatgattataagtaaccataaaataatagtcatttttttagccaatgtaataattaaaagattttttaaaaccaaaacctttactctttgatagaggagactcagttttccaaccaaacgacctaagaaagatagcctgagacagaatgtctctcctctcttctattttttatagtttactcaaaggcgaacaaagatattttactgtcatttattaatactccattgaaattttcctcaaaagagaaaaccaaattttatttttagattactgtattatcaatgctaaagctaattgtaataaaacttataactaaatctatgaaatttgtcatctttcgaccacacaagatttccataggtcttttatgttttacatttttccccaacttcctaggtttatgtaattttgcctattttttagtccttcaatttgaaatgtttaaataacttcaaactagataaaaaaaattttaaatacacattttatgtctttattagtttcctcatcaaaagcatatcttgcttttgtttatacattctgtatacagaattgtttcatatctagtagtagtaatataattatatataaactctaatttaactattagaaccctaatttatagtgaaaactctgaaagtaattttgaactgttttatatcagtatttacaaataaaaaccattttataatttttttcaaaagatggttcaagttattgttttttaacagacctaaatatatttagcttttctgtacaatataaaaaaagtcaaggtatatagaattaaactcatgtttaataagtaatatttcagtttttaacttacaaatgattcagatattttatgtctatgtgttaattaatttagcatagtatgtaagatttgaaatgactgaaataaattttgaaactatgacacaggtaccttccctaatgtcttccccagtcatcttgggtcccaagtagccatgtggcatccaggaggactatgaagggtagggcctgtctgagtcctgaatttgcataccaggtatagaggtcaggacagaagacagagctgtgaagactatacctggagaatctaaccactcccgaagtaaccaggaggcaaagctggggcagggaagaaagggccatattgggtttgactttgctgcatagttgctggtctaggcactgaaaacatgtctccagacctcaccatggccacctatgcagacccccaaacccagaggctctgaaccaaaacataagctccacagtcaaatcaagcaagtatcaaattatattcaattgtattttgaagtcattcctattttaccaagaattttaaaacaagttttatttatcaaatattatcacatacgcataatacatatagacctacaaacacacagacagaagcagattttatacctttcttaaaggattctcatttgccagtttttaaagagtttttcttttccccattcagcctatcaatcttccaattacctattttgtcaccctaagccattgttaactaggcaacaaatttgcatttctaaagggaaaactcttaggtgaagcaagaaaatttctatttcaaaagcacagagctaacactttaggcctaaatacagtaccatttgctcaaaccaaggggaaagtggtgtaagtaaaagttaagttagataagacggccagaaaagcaccttaaacagatatatgacttgtgcaaattaaaacaatgggaagagtttctaatgtacataggcagacatcttacaaatggagatttcctttataggtgtgaatttcttttacaaaagggtttcaggaaagccagttaaattccagaaaggtgtattccagtttgataggtggtgatcttttaaacttagctattgtttcttagctaaaattactgagttcaggatggagtccattaaggaatagagcaaagaaagcattctctaggcctggactcagcatggatgggtctgaaaaagcaaggctacttttcccaagggcctacttaatttttgtgggtatatagtaggtgtatatggggtacatgagatgtattgaaacaggaatgcaatgtgtaataattacataatggaaaatgggaattgcatcccctcaagcatttgtgtaaaaaacaattcaattatgctcttttagtaatttaaaaacatacaattaaaatattattgactattgtcaccttgctgtactatcaaatactagtttgatagtaggattgctgaatcatacggtaagcctattttaagttttctgaggaatctccaaactgttctccacagtagttgtactaatttacattcccaccaataatgtatgagggttctcttttctccaattcctcaccagcatttattattgactgtcttttggatataagccattttaactagggtcagataatatctcactgtagttttgatttgcacttctctgatgatcaatgatgttgagcactttttcatatgcctatttgctgtttctataccttcctttgagaaatgtcttttcaaatcctttgcacattttttatcaaattattatattttttcctacagtgctgtttgagctacttatacattccgcttattaatcccttgtcagatggggagtttacaaatattttctcccattctgtgggtagtctcttcactttgttgattgtttccttcactgtgcagaagctttttagcttaatgtgatcccatttgtctatttttggttggttgcctgtgcttgtggggtattactcaagaaattttgcccagatcaatgtcttagagagttccccaatgttttcttgtagtagtttcacagtttgaggtctcaggtttaagtctttaatccattttgatttgatttttttatgtggcgagagataggcatctagtttcattcttctgcatatggatatccagtttttccagcactatttattgaagagattgtcttttccccagtgtatgttcttgacacctttgtcaaaaatgagtttactgtaggtgtatgaatttgtttctgggttctctattctgtttcattgatgtatttgtctgttttaatgccaacaacatgctgttttggttactacagatctgtagtataatttgttttttgtgggtttttttttttgtttttattgtttccactttattgctctagcatggaacttcaggcaagcctggaccttcatcaacatgcaaagaagaggctgagggggtttggggacacaacctggctgagagggaaaactgacaggggaaataccagaacgggggacagggggtggtcaccatgacaccaggagacagcatcagccatgccatctggggtgaggaagggaacagagaagaaatggtgtttcttcccatgtccctaacacccacatggaggccacatttggaaatggactgggagagggaaaggatgaggaaaacagctgcccaggagtctccttctccaccctgggttcatatcagaccccatccctaccacttgcctcttctacccctggaaaatggacctaacaaacagaaggagcaaaataaattaacactctaatgagcatgtatggatggacatatgttcatgtgcaatgggggaagggaagagggggtgacaccacctaaaatgattccccacctcaatctcccagcctactcctttcccccttccccctaaagccaccatccaaccagatagaaaaataaaggtctaattcactcaaaattcttcagtttttacaaaactaacagggcagagtagggagacggggggcaggcagccacaggagtagggctggtggagaggggctatgcttctgtctccacttgagactggctctctgtggtgttgctcttctgctcctccatctctgtgtcagtgagattgtctcctgaggaagcctctgccttggccttgttctcttcctcagccagcctctcaaacgtgttggcgtagagcgtcttctcccaggcaagctgcctgcagatctgctgctggcacacagccagctgggccttggcggcttcgttgttggggtagagctgcaagaccttctggaagtcagcctgtgccagttcaaagtcattcacagccaggtgggcctctccccaatggaagaggcccttctcgttgttgctgcccagttccagggccttgttacagctttcagtggcagcagagaaggcctgtagtttcagatgacacatggccaggttgaggtaagaggccagttgaagggcctgtgccttctgtgtttcctcattggaaaaactagactcatattctacccaggacacaatcctcttatattatagtaaagcttgcttgtatttgccttccttgaagtacacagtgtcccactctttcactgtggtgctctgctccagcttctcttctgaattcatctcccaagactccttggtcttttcaaaactcttgaggtgtaattcatatttcagctaggcatttggtgggatttggaacttttccttcctaacactgccaaaagcatagctgggtttgaggtacacaatggaatgttctcctttctacatgcactgaatggccctctccagaccataaggcagatccagattctcctgatgttcaaagaactagtccttgtagcacccttccagtgcaatctccatgatagcaccctcattgggcctgggatagccttcaccgcaagtctgtaattctgtagatgattccgccatcttcttcttccgtcagatcttctcccttaaactcaaacaactccacctcaaacacgagtgtggcattggggagatctttggaggactgcctgctgcaccgaaggcatattctggtttgcaggtgatatggcacacctcccctgccttcatggctgctatggcaatgtcccaagccttgttgacctccccttttcccaggtcaaaggagaatttgtccttgtgatccagactggggtcaaagtttgtgccatctaacagccagccagtgtagtggacaaagattcagtccccaatcatgggcatctctgtacctgtgccctctctcgatgaccttcagcatgccttcctcctgtttgggcgaatgtccactccctccatgggaagaggcgccaactgtgtcccattctcagtctccttcatctcctcaactgtcatctccacgcagcgcaccctttctgggagctggcaccggcaccagcatactctgagccaaaggcaggggtgctaccttcagggtgtgcaggaggccaggtgctgtggtgctgactgcggaccacatggaggctggagcacctctgccagtctgtagtatgatttgaagtcaggtaatgtgattctctccagttttgttctttttgctcaggatagctttgactattctggatcttttgttgtaccatgtaaattttaggatagttttttattattaatatttctgtgaagaatgtcattggtattttgaaagggactgcaatgaatatgtagattgctttgggtgatattgacattttaacaaaattgattcttcccatccatgaacatggaatgtatttctcttttttggtgtcctcttcaatctcttttatcagtgttttatagttttcattgtagagatcatttctttggttaaatcctaggtgatatggtttggctgtgtccctacccaaatctcaccttgaattgtaatagtctccacttgtcaagggtggggccaggtggagataattgtataatgggggcagttcccccatactgttctcatggtagtgaataagtctcatgggatctaatagttttataaatgggagttcccctgtacaagctctcttgcctgccaccatgtaagacatgcctttgcttcttctttgccttctgccatgattgtgaggccttcccagccttgtggaactgtatgtccattaaacctttttcctttataatttacccagtctggggtatgactttattagctgcatgagaacagactaatatgctacatatctaattttatttgtggctattataattaggattactttcttgatttctttttcacactgttcactattagcatatacaaatgctactgatttttgtatgttggttttgtatcctgcaactttacaaaatttatcagttctaatagttttttggtggcgtctttgggttttcccaaatataagataccatctgcaaacaaggataacgtgacttcttcctttccagttggatgccctttatttcttcctcttgtctgattgctgtagctaggacttctagtactatgttgaataacagtggtgaaagtgggcatccttgtcatgatccagatgggagagggaaggttttcaggttttccccattcagtatggttttagctatgggtctgtcacatatggttttaattatgttaaggtatgctccttctatacgcagttttttgagggtttttcatgaagggatgttgaattgtatcaaatgcttttttaacatctactgacatgatcatacggatttgtccatcattctactgatatgatgtatcacattgattgatttgtgtatgttggaacatccttgcaagccagagataaatcccacttggtcatgatgaatgaccttttttaccatattagtgaatttggtttgctaataccttgttgaggccttttgcatcaagattcatcagagatactggcctgtagttttctttttttgatgtgtctatgtctggttttggtatcagagtaatactggcttcatagtatgtgctgggaagtagtccctcctcctctattttttcagaattgtttcagtaggattgctattagttattttttaaatgtttagcataattcagtattgaagtcattgggtcctgggcttttatttacagggagatttttaattacaacttcaatcatgttacttgttattggtctgttcaagttttggatttcttcatggttcaatcttggtaggttgtatgcatctaggaatttgcccatttcttctagattttccaattttttggcatacagttgctcacagtagccagaaattatcatatgaatttctgcattatcagttataatatctcctttttcatctctgattttacatatttggatcttctttttttttcttaggcaagctaaaagtttctcaattttctttatctttaaaaaaacttttcgattcattgatcttttgtattgtcttcttcatttcaatttgatttatttctgctctgatctttattattccttttcttctactaattttggatttggtttgctcttgcttttctacttctttgaggtgcatcattaggttgtttatttgaagttttttttttttttaatgtaggcacttatagctataagcttccctattagtactgcttttgctgtattccatacaacaaaatggtatgttgtgtttccattatcattttttccaagaaatttttcaatttccatcttaatttcttcatttacccactggttgttcaggggcatattgtttactttccatgtgtttgtatagttttcaaaattcctcttgttattgatttctagttttattccattgtggtcagagaatgtgcttgatatgattaacatttttttgaatgttttaagacttgttttgtgacctaacatatgatctgtccttcagaataatctatatgctggggaaaagaatgtgtattctgcagtctttgaaggaaatgttctgtaactatctattagatgtttctttgttgattttctgtctagaagattgatgcagtgttgaaagtgggatgttgaaatctccagctattattatattggggtctacttctctctttagctctaataatattttctttatacatctaggtgctccagcattcagtgcatatatatttaaaatcgttatatcctcttgctgaattgaaccccttatcattatatagtgaccttctttgtctattcttacagtttttgtcttgaaatctattttgtctgatatgaatatagctgcttctgctcttttttggtttccatggacttggaatatcttttccatccctttattttccatgtgtgttttataggtgaagtctgtttcttgtgggcaacagatcattgggtctcagtttttggggggttttttggtgtgttttgttttgttttttgtttattttttggcttttggctttttttttttttttgagatggagtctcactctgtcaccaggctggagtacggtggcacgatctcggcttgctgcaacctccgcctcctggattcaagcaattctcctgcctcagcctcctgagtagctgagactacagacacacaccaccacgcccagctaatttttgtatttttagtagagacagggtttcaccatgttggccaggatggtcttgatctcttgaccaagtgatatgcccacctcagcctcccaaagtgctgggattacaggcgtgagccaccacacctggcctcattgtttttttattccttcagctactctgtgtcctttgaagaactgtgtccatttacattcaatttatagataagtaaggacttacccctgccattttgtgatttgttttctggctgttttgtggtcttctcttccttctttctttccttcatgtctttctttttgcgaaggtaattttcattggtgatatgatttagttagttgctttttattttttgtgtctccattgtatgttttttgatttgagggtatcatgaagcttgcaaatactacgttataacccattattttaagctgataataacactgtttgcataaacaaactaacaaaaagaaaatttacaaagacttcctgcattaactttgtgcccctgctttaagtttttgttactatttatatcttattgtaatatgtcttgaaaagttgttgtagttactatgtttgattggtaagtcatttaatctttctccttaaataacagtagtttacacaccacatttacagtgctataatattctgtttttctgcagactattactagtggattttgtaccttcaggtgattatttattgctcattaatgtccttttctttcttattaaagtactccctttagcatttcttgtaaaaaaaaaagtctgatgttgatgaaatccctcaactttttttttgtctaggaaagtctttattttttcttcattcttgaaggatattttcaccagatatactattctagcataaaagttctcttcccttcagcactttaaatatttcattccactctctcttggcctgtaaggtttccactgaaaaggctgccactagatgtgttggagctccattatttgtttcttttctcttgctgctttttggaacctttttttatccttgacctttgcaagttgaattaccagatgccttgagttagtcttctttgcatgaaatctgcttggtgttctgtaaccttcttgtacttggatactgatatctttctctaggtttaggaagctctctgttattatccctttgaataaagtttctatgcatatctctttctctacatactctttaaagccaataactcttagatttgcccttttgaggctattttctagatcctgtaggcatgcttcatggttttttattctttttgcttttgtctcctctgactgtattttcaaatagcctgttttcaagcttgctgattcttttttctgcttgatcaactctgctattgaacgagtctgatgatttcttcagcatgccagctgcatttttcaactccagaatttctgcatgatcctttttaattattttaatctctttgtcaaattcatctgatagaatcctgaatttcttctctgtgttatcttgaatttctttgggtttcctcaaacagctattttgagttctctgtctgaaaggtcacatatccctgtttctccaggcttggtttctggtgccttatttagtttattcattgaagtcatgttttcctggattgtctggatacttgtaggtgttcatttgtgtctggccattgaagagttaggtatttattgtagtctttgcagtctgggctctttatacccattcttcctgggaaggctttccagatattcaaaaggacttgggtgttatgatctaagctatatctgctttagagaggacccccaagaccagtaacactatgattcttgcagactcatagaggtactgccttgatagtcttggacaagatccagaagaattatctggattaccggagactctggttctcttcctttactttgtcccagtctctctctgtgctgagccacctggagctagaggtggaatgacacaagcacccctgtagccatcacccctagaactgtgctgggtcagacctgaaaccagcagagcactgggtcttgcccaagccctgctgtaaccactctttggctaccagctatgttcattcaaggccctgaagatctgcaattagctggtgacagagccagccaggcctatgttcttcccttgagggtgatgagtttctccaagcccaagctccaggagggtccagaggtgccattcaggagccagaaactagagtcaaaaatcttagaagtctacctggtgttctattgtactgtggctaagctggcactcaaaccacaagacgcagcgcttcccatgcttccctcccctttccaaatgcagcgagcctcacctcatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctacccagctgtagggcctaccttatataaactttttatccaggatagctttcttttttgtctttgggacagtattgtaactaagcaaaaagataagcggatttaatttttcttattagtcatttaagatttttatttgccttttataaggagtctttaatttaaaatactgaaatactttagaagcttctgcatatcagtaggcatccatagatgagagtaatttggaaagcttcattttcttttctttttttttaatttcaacttttattttaaatacagggtacatgtacagatttgttacataggaatattgtatgatgctgaagtttggagtacaggttccctcaccctggtagtaagcataatatagtactcaataggtagtttttcaacccacccactcccaagctcgagtagtccacagtgtctatcgttctaatatttatgtccatgtgttctcaatgcttagctcccaattagaaggaagaacatgcagttttgaattttctgtttctgcattaatttgctgaggattatggcctccagctccatccatgttgctgcaaaggccatgatttcatttttttataactgtgtactattccgtggtgtgtatatacagcattttctttattcaatccaccactgatgggcagctaggttgatcccatgtctttgctagtgtgaatagtgcaacaatgaacagaaaagtgcatgtgtctttttggtagaatgatttattttcttctgggtgtaaacctagtaatggtatggctgagatgaatggtagccctgttttaggttctttgagaaatctccagattgctttccacagtggctaaactaatttaaattcccactaacaatgtataagtgtccacttttctccacatcttcaccagcatctgttgttttttggatttttagtaacagccattctgactggtgtgagattttatctcactgtcagtttgatttgcatttctctgatgattagtgatgctgagcattttttcatgtttgttggtgacttgtatgacgtcttttgagaagtatgtgttcatgtcctttgcccattttttaatgaagttatttggtgttttgcctgttgatttgttcaagctccctatagattctggatactaggccattgttggatgcatagtttgcagatatcgtctctcattctgcaggttgtctgtttgctttgttcatagtttcttttgttgtgcagaagctttttagtttaattagatcctttttgtcttgttgttgttgttgttgcaatggcttttcatacttagctaaaaattttttaccaaggctgactttgagataagtatttcctaggttgtcttccaggatctttacagtttgaggaccttcattgaaatctttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcagattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatagtgtagccttgaagttgggtaatgtgatacctctggcttcattcttttgcttaggatagctttggctattggggctctttttcagttccatatttattttagaatcatttgttctgtgaaaaatggctttggtagtttgataggaatagtgttgaatctttaacttgctttggacagtatggccatttttacgaaactgattcttccaattcatcggcatggaatgtttccccatttatgtcatctctgatctccttctgcaatgttttgtagttctctttgtagagatctttcacctccttggctacctgtattcctagatatttcattttcttttggctattgtaaatgggattatgttcttgatttcactctcagcctggactttgttggcatatagaaaatgctactgatttttatacaatgattttgtaacctgaaactttactaaaggtgtttatctattctaggagactattggcaaagtctttaggattttctaggtatagaattatgttatcagcaaacagggagagtttgacttcctttcctatttggatgccttttatttctttctcttgcctgattgttccagctatgacttccagtactgtgttgaacatgagtggtaagagtgtgcatcttggttctgttccagttctcaaagggaatgcttcaagctattgtccacttagtatgatgttggctgtgggtttgtcatagatggctcttattattttgaagtatgttccttcattgcctagtctgttgagggtttttaacatgaagggatgttggatttcatcaaaagctttttctgcatctattgagaagataatttcatttttgcttttgattctgcttatgtagtgaatcacatttattcatttgcatatgttgaaccagccttgcattccaggaataaagcttacttgatcatgttttactaacttttcaatatgctgctggatttgattttctagtattttgttgaggattttcaggtctatattcatgagagatattggtctaaagtttcctttattaattgtgtctctgccagatttgggtaccaggctgatgctggcttcatagaatatattagaaaggaacccctcctctttgattttttgaataatttcagtaggattggtatcagttctttgtatgtctggtagaattcagctgtgaatccatctgagccagggctttttttggttagtaggttcttaattactgattcaatttcagaagtcgatagtggtctattcaggttttcaatctcttcctgattcagtcttggaagattgtgtccttccaggaatttacctacttcctctagattttctaatttgtgtgcatagggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggtagaacacaaaaatccctataaatttccaaaaccaaagtttgcatcccctgaaatattgccattttctactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggatcccacttctgacaccatctgtttaaaaaaaaaaaaaagccttagacaaattaaacttcacagagtttaactgagcaaagaatgatctgtgaatctggcatctggcagcctccttagccagagtaagctcagagagactccagtgcagccacgtggtggaagatttacggtcacaaaaaggaaagtgacatacagaaaatggaagtgaggtacacaaacagccagattggttacagctcaacatttgccttatttgaacatgttttgaacagttggctgcctctgactggccaaaacttggtgactggcacaagagtaggttactgtctatttaaacttccattgaggttactgttcactatgtacagagaaatctttatgccaaacttaaagtatgtaaggaagcaactttaggataaacttgatttaacaatattacatgtgaatatgtgtatatacacatgtgtctttgtgaatataaatataaatctatctatatatattctctaagatattggcacttctaataaagtggttattaaataatatttaaagataaaaacaatgaatttgattagtttagaaagcagagaaagttaacagagcaattctaacacaaatatagttgcttatcattttcagtgtgaaattagagtcaacaaacccatgattttcttagtattcactcactctatatctgtgtacaagtaattggcttattatattaaagttgctttttacttcattttatgttaactctaaaaaactgttaattgtggagtttttaaatgttgttcaatttcttttcattttaataataatattgttaatgttatcattgcttctattttctatgtgcctaacatttctctagagttgagcaggccttatcttccactttatagtgacagtaaattcatttgtgaatggggaagattttcatttatgcagatgggcttgagatagacaaatagatactcaaagagaacaacagagaaatacacaagaatatacacaatatttatactaatttatcatctatttacagaatgatagacattgccattgagttcatatgctagatacattgagtttatctatttatatatcatttaaaaaacagaatggaaatcttcctatatacagtaaacctttccctgccctctaaatcaggatattccacccataatttgcttatctcattgtgctctaatacattgacactcacagaatataggacagttgtatctacattagatggttccagttagtgatgctaatgttcttgttcagcttttcataggtgtttatttcttcaactttagagacagagttcaagatattagtcatttcttgctgctattctctgccagataagtcaatgtagtacaatgtgagagtctaggctttgcatccagatagacctgagattaaatcctgatcaactctttactagttatatggcttgtctgactgtaaagtggagatgataatatccacctccataaggttcttcttataggtgatgacagtacaaatatacagtactggccacctatcgggctttcttttttttttttttttttgagacggagtctcgctctgtcacccaggctggagtgcagtgccgcgatctcggctcactgcaagctccgcctcccaggttcacacccttctcctgcctcagcctcccgagtagctgggattacagaagcccgccaccacgcccagctaattttttgtatttttagtagagacagggtttcaccgtgttagccaggatggtctcgatctcctgacctcgtgatccgcccacctcggcctcccaaagttgggctttcaatagatatgtgtctcttgccactaccctctacaacacccacaacacccaacacccacccacattcatccccttttcatgctttccttcctgtcatctgtgaactgggcaactacataacgaagaagatttgaattatatctaaaccaaaatccagttattataatagaagtatttatttattctgagtgtacactattaattagcaaaacaaagaacataagcctaaaggctaacctatttggacctttaggtgggtaatatttgagatggtccttgaaagttgataggatttagactgaaagacatatgtagagaagcattctgtacagaggaaactgtttcaggcctaaagcacagcatagaacaaggaatgattcaatttatctggaatatagggtgtatgtggtagaagataaaactcaagaatgaatataggcctgttttgtcaaggattctgagcaccaggttaagaagtttaatttgatggaaaataggagttactgatatttcctaagcaaaggacttttgttttaggaggatttctctgtgttagcatttgggatatattagtgctgggagaaacaaaagtgaggaggtcatttagaaagttattagagtggttcaagcaaaaagtaacaaagactaactctcacacattactagtggtaatgtaagtcagtacaatctctatgacaggcaacttggcaatctctaccaacattacaaacgcacataccattttccttagccattccacttctaagaatttatcctcagatatattttcgaatgagtgaagtgatgcatataccaagttattcataatagcataaaaccttaataagaacttgaataacttacagcacattcacagtaacagaattacagcatatatatatataataagaatggggaagtcccttatgtactgattaaaacaatctctaagatgtattaaatttttaaaaattaatatattaaattgtgtaccatttgcttccatctgtgttttaaaaataaaagaaaattctggaagaatacacacacacacacacacacacacacacacacacacacacacacaaattatatctgtggcttcttgttgaatccaaaataaatattaaaagaaataaggcctaaagtcaaagtggtacctataatattggagagataacttattagaagttgatagtgggggaaaatttataaagaaagaatatggacttagaagaacagaaatttgtagaaagcctagtattgaatagtattatgccatgttatggcatgaagcagatgagtgtagatttgcgtgctttaagcagaaagaaaatttaagaaatcatgtttgcagaatataattgtcatcccaattttgccaaacaggcaccaaaatgcttggagatttattgtttcacccaaagtcacacaagtgatgacacagtaaaaacaaaaaacttctttcaaagttttatctaaagctccaatggcatagatatttagacaagtatagacaattgccttcacagctggaagtgccctcttcctccctcaccagttacccatgtaccttccctaacaaggtgaattttcttattcagcaggaaatattccctagacattagtgtttaatgaaaccatttattaaaatccgtgtaattctttcaaaattctaacatatccgaggcttgcctgattctgataataatattcaagcaaagatttttagaaaattttctttaagtcagtatgaaattttgacatttagtcaagattgaatctatggttcagatttcataacctcattaagtctccttgtgcctcttatgtgcagttctgggtacttactattatgtggaagggttaacatttttagaaaggaaacatttataaaccctagttctttttaacaagctgatttagctagttcctaagataatttactttcagaaagtataaccctttactacataacagtattaacttatagattgatttatctatcaataagttatttaagggagttataatttaaagcaataacaaaaaataatacaccaaatgtgaatctaccactgcaaaatttttaatagatacatggtttagttacagtctttta

SEQ ID NO: 131 - DNA, 16827 bp, Homo sapiens
tgaggaagggaacagagaagaaatggtgtttcttcccatgtccctaacacccacatggaggccacatttggaaatggactgggagagggaaaggatgaggaaaacagctgcccaggagtctccttctccaccctgggttcatatcagaccccatccctaccacttgcctcttctacccctggaaaatggacctaacaaacagaaggagcaaaataaattaacactctaatgagcatgtatggatggacatatgttcatgtgcaatgggggaagggaagagggggtgacaccacctaaaatgattccccacctcaatctcccagcctactcctttcccccttccccctaaagccaccatccaaccagatagaaaaataaaggtctaattcactcaaaattcttcagtttttacaaaactaacagggcagagtagggagacggggggcaggcagccacaggagtagggctggtggagaggggctatgcttctgtctccacttgagactggctctctgtggtgttgctcttctgctcctccatctctgtgtcagtgagattgtctcctgaggaagcctctgccttggccttgttctcttcctcagccagcctctcaaacgtgttggcgtagagcgtcttctcccaggcaagctgcctgcagatctgctgctggcacacagccagctgggccttggcggcttcgttgttggggtagagctgcaagaccttctggaagtcagcctgtgccagttcaaagtcattcacagccaggtgggcctctccccaatggaagaggcccttctcgttgttgctgcccagttccagggccttgttacagctttcagtggcagcagagaaggcctgtagtttcagatgacacatggccaggttgaggtaagaggccagttgaagggcctgtgccttctgtgtttcctcattggaaaaactagactcatattctacccaggacacaatcctcttatattatagtaaagcttgcttgtatttgccttccttgaagtacacagtgtcccactctttcactgtggtgctctgctccagcttctcttctgaattcatctcccaagactccttggtcttttcaaaactcttgaggtgtaattcatatttcagctaggcatttggtgggatttggaacttttccttcctaacactgccaaaagcatagctgggtttgaggtacacaatggaatgttctcctttctacatgcactgaatggccctctccagaccataaggcagatccagattctcctgatgttcaaagaactagtccttgtagcacccttccagtgcaatctccatgatagcaccctcattgggcctgggatagccttcaccgcaagtctgtaattctgtagatgattccgccatcttcttcttccgtcagatcttctcccttaaactcaaacaactccacctcaaacacgagtgtggcattggggagatctttggaggactgcctgctgcaccgaaggcatattctggtttgcaggtgatatggcacacctcccctgccttcatggctgctatggcaatgtcccaagccttgttgacctccccttttcccaggtcaaaggagaatttgtccttgtgatccagactggggtcaaagtttgtgccatctaacagccagccagtgtagtggacaaagattcagtccccaatcatgggcatctctgtacctgtgccctctctcgatgaccttcagcatgccttcctcctgtttgggcgaatgtccactccctccatgggaagaggcgccaactgtgtcccattctcagtctccttcatctcctcaactgtcatctccacgcagcgcaccctttctgggagctggcaccggcaccagcatactctgagccaaaggcaggggtgctaccttcagggtgtgcaggaggccaggtgctgtggtgctgactgcggaccacatggaggctggagcacctctgccagtctgtagtatgatttgaagtcaggtaatgtgattctctccagttttgttctttttgctcaggatagctttgactattctggatcttttgttgtaccatgtaaattttaggatagttttttattattaatatttctgtgaagaatgtcattggtattttgaaagggactgcaatgaatatgtagattgctttgggtgatattgacattttaacaaaattgattcttcccatccatgaacatggaatgtatttctcttttttggtgtcctcttcaatctcttttatcagtgttttatagttttcattgtagagatcatttctttggttaaatcctaggtgatatggtttggctgtgtccctacccaaatctcaccttgaattgtaatagtctccacttgtcaagggtggggccaggtggagataattgtataatgggggcagttcccccatactgttctcatggtagtgaataagtctcatgggatctaatagttttataaatgggagttcccctgtacaagctctcttgcctgccaccatgtaagacatgcctttgcttcttctttgccttctgccatgattgtgaggccttcccagccttgtggaactgtatgtccattaaacctttttcctttataatttacccagtctggggtatgactttattagctgcatgagaacagactaatatgctacatatctaattttatttgtggctattataattaggattactttcttgatttctttttcacactgttcactattagcatatacaaatgctactgatttttgtatgttggttttgtatcctgcaactttacaaaatttatcagttctaatagttttttggtggcgtctttgggttttcccaaatataagataccatctgcaaacaaggataacgtgacttcttcctttccagttggatgccctttatttcttcctcttgtctgattgctgtagctaggacttctagtactatgttgaataacagtggtgaaagtgggcatccttgtcatgatccagatgggagagggaaggttttcaggttttccccattcagtatggttttagctatgggtctgtcacatatggttttaattatgttaaggtatgctccttctatacgcagttttttgagggtttttcatgaagggatgttgaattgtatcaaatgcttttttaacatctactgacatgatcatacggatttgtccatcattctactgatatgatgtatcacattgattgatttgtgtatgttggaacatccttgcaagccagagataaatcccacttggtcatgatgaatgaccttttttaccatattagtgaatttggtttgctaataccttgttgaggccttttgcatcaagattcatcagagatactggcctgtagttttctttttttgatgtgtctatgtctggttttggtatcagagtaatactggcttcatagtatgtgctgggaagtagtccctcctcctctattttttcagaattgtttcagtaggattgctattagttattttttaaatgtttagcataattcagtattgaagtcattgggtcctgggcttttatttacagggagatttttaattacaacttcaatcatgttacttgttattggtctgttcaagttttggatttcttcatggttcaatcttggtaggttgtatgcatctaggaatttgcccatttcttctagattttccaattttttggcatacagttgctcacagtagccagaaattatcatatgaatttctgcattatcagttataatatctcctttttcatctctgattttacatatttggatcttctttttttttcttaggcaagctaaaagtttctcaattttctttatctttaaaaaaacttttcgattcattgatcttttgtattgtcttcttcatttcaatttgatttatttctgctctgatctttattattccttttcttctactaattttggatttggtttgctcttgcttttctacttctttgaggtgcatcattaggttgtttatttgaagttttttttttttttaatgtaggcacttatagctataagcttccctattagtactgcttttgctgtattccatacaacaaaatggtatgttgtgtttccattatcattttttccaagaaatttttcaatttccatcttaatttcttcatttacccactggttgttcaggggcatattgtttactttccatgtgtttgtatagttttcaaaattcctcttgttattgatttctagttttattccattgtggtcagagaatgtgcttgatatgattaacatttttttgaatgttttaagacttgttttgtgacctaacatatgatctgtccttcagaataatctatatgctggggaaaagaatgtgtattctgcagtctttgaaggaaatgttctgtaactatctattagatgtttctttgttgattttctgtctagaagattgatgcagtgttgaaagtgggatgttgaaatctccagctattattatattggggtctacttctctctttagctctaataatattttctttatacatctaggtgctccagcattcagtgcatatatatttaaaatcgttatatcctcttgctgaattgaaccccttatcattatatagtgaccttctttgtctattcttacagtttttgtcttgaaatctattttgtctgatatgaatatagctgcttctgctcttttttggtttccatggacttggaatatcttttccatccctttattttccatgtgtgttttataggtgaagtctgtttcttgtgggcaacagatcattgggtctcagtttttggggggttttttggtgtgttttgttttgttttttgtttattttttggcttttggctttttttttttttttgagatggagtctcactctgtcaccaggctggagtacggtggcacgatctcggcttgctgcaacctccgcctcctggattcaagcaattctcctgcctcagcctcctgagtagctgagactacagacacacaccaccacgcccagctaatttttgtatttttagtagagacagggtttcaccatgttggccaggatggtcttgatctcttgaccaagtgatatgcccacctcagcctcccaaagtgctgggattacaggcgtgagccaccacacctggcctcattgtttttttattccttcagctactctgtgtcctttgaagaactgtgtccatttacattcaatttatagataagtaaggacttacccctgccattttgtgatttgttttctggctgttttgtggtcttctcttccttctttctttccttcatgtctttctttttgcgaaggtaattttcattggtgatatgatttagttagttgctttttattttttgtgtctccattgtatgttttttgatttgagggtatcatgaagcttgcaaatactacgttataacccattattttaagctgataataacactgtttgcataaacaaactaacaaaaagaaaatttacaaagacttcctgcattaactttgtgcccctgctttaagtttttgttactatttatatcttattgtaatatgtcttgaaaagttgttgtagttactatgtttgattggtaagtcatttaatctttctccttaaataacagtagtttacacaccacatttacagtgctataatattctgtttttctgcagactattactagtggattttgtaccttcaggtgattatttattgctcattaatgtccttttctttcttattaaagtactccctttagcatttcttgtaaaaaaaaaagtctgatgttgatgaaatccctcaactttttttttgtctaggaaagtctttattttttcttcattcttgaaggatattttcaccagatatactattctagcataaaagttctcttcccttcagcactttaaatatttcattccactctctcttggcctgtaaggtttccactgaaaaggctgccactagatgtgttggagctccattatttgtttcttttctcttgctgctttttggaacctttttttatccttgacctttgcaagttgaattaccagatgccttgagttagtcttctttgcatgaaatctgcttggtgttctgtaaccttcttgtacttggatactgatatctttctctaggtttaggaagctctctgttattatccctttgaataaagtttctatgcatatctctttctctacatactctttaaagccaataactcttagatttgcccttttgaggctattttctagatcctgtaggcatgcttcatggttttttattctttttgcttttgtctcctctgactgtattttcaaatagcctgttttcaagcttgctgattcttttttctgcttgatcaactctgctattgaacgagtctgatgatttcttcagcatgccagctgcatttttcaactccagaatttctgcatgatcctttttaattattttaatctctttgtcaaattcatctgatagaatcctgaatttcttctctgtgttatcttgaatttctttgggtttcctcaaacagctattttgagttctctgtctgaaaggtcacatatccctgtttctccaggcttggtttctggtgccttatttagtttattcattgaagtcatgttttcctggattgtctggatacttgtaggtgttcatttgtgtctggccattgaagagttaggtatttattgtagtctttgcagtctgggctctttatacccattcttcctgggaaggctttccagatattcaaaaggacttgggtgttatgatctaagctatatctgctttagagaggacccccaagaccagtaacactatgattcttgcagactcatagaggtactgccttgatagtcttggacaagatccagaagaattatctggattaccggagactctggttctcttcctttactttgtcccagtctctctctgtgctgagccacctggagctagaggtggaatgacacaagcacccctgtagccatcacccctagaactgtgctgggtcagacctgaaaccagcagagcactgggtcttgcccaagccctgctgtaaccactctttggctaccagctatgttcattcaaggccctgaagatctgcaattagctggtgacagagccagccaggcctatgttcttcccttgagggtgatgagtttctccaagcccaagctccaggagggtccagaggtgccattcaggagccagaaactagagtcaaaaatcttagaagtctacctggtgttctattgtactgtggctaagctggcactcaaaccacaagacgcagcgcttcccatgcttccctcccctttccaaatgcagcgagcctcacctcatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctacccagctgtagggcctaccttatataaactttttatccaggatagctttcttttttgtctttgggacagtattgtaactaagcaaaaagataagcggatttaatttttcttattagtcatttaagatttttatttgccttttataaggagtctttaatttaaaatactgaaatactttagaagcttctgcatatcagtaggcatccatagatgagagtaatttggaaagcttcattttcttttctttttttttaatttcaacttttattttaaatacagggtacatgtacagatttgttacataggaatattgtatgatgctgaagtttggagtacaggttccctcaccctggtagtaagcataatatagtactcaataggtagtttttcaacccacccactcccaagctcgagtagtccacagtgtctatcgttctaatatttatgtccatgtgttctcaatgcttagctcccaattagaaggaagaacatgcagttttgaattttctgtttctgcattaatttgctgaggattatggcctccagctccatccatgttgctgcaaaggccatgatttcatttttttataactgtgtactattccgtggtgtgtatatacagcattttctttattcaatccaccactgatgggcagctaggttgatcccatgtctttgctagtgtgaatagtgcaacaatgaacagaaaagtgcatgtgtctttttggtagaatgatttattttcttctgggtgtaaacctagtaatggtatggctgagatgaatggtagccctgttttaggttctttgagaaatctccagattgctttccacagtggctaaactaatttaaattcccactaacaatgtataagtgtccacttttctccacatcttcaccagcatctgttgttttttggatttttagtaacagccattctgactggtgtgagattttatctcactgtcagtttgatttgcatttctctgatgattagtgatgctgagcattttttcatgtttgttggtgacttgtatgacgtcttttgagaagtatgtgttcatgtcctttgcccattttttaatgaagttatttggtgttttgcctgttgatttgttcaagctccctatagattctggatactaggccattgttggatgcatagtttgcagatatcgtctctcattctgcaggttgtctgtttgctttgttcatagtttcttttgttgtgcagaagctttttagtttaattagatcctttttgtcttgttgttgttgttgttgcaatggcttttcatacttagctaaaaattttttaccaaggctgactttgagataagtatttcctaggttgtcttccaggatctttacagtttgaggaccttcattgaaatctttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcagattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatagtgtagccttgaagttgggtaatgtgatacctctggcttcattcttttgcttaggatagctttggctattggggctctttttcagttccatatttattttagaatcatttgttctgtgaaaaatggctttggtagtttgataggaatagtgttgaatctttaacttgctttggacagtatggccatttttacgaaactgattcttccaattcatcggcatggaatgtttccccatttatgtcatctctgatctccttctgcaatgttttgtagttctctttgtagagatctttcacctccttggctacctgtattcctagatatttcattttcttttggctattgtaaatgggattatgttcttgatttcactctcagcctggactttgttggcatatagaaaatgctactgatttttatacaatgattttgtaacctgaaactttactaaaggtgtttatctattctaggagactattggcaaagtctttaggattttctaggtatagaattatgttatcagcaaacagggagagtttgacttcctttcctatttggatgccttttatttctttctcttgcctgattgttccagctatgacttccagtactgtgttgaacatgagtggtaagagtgtgcatcttggttctgttccagttctcaaagggaatgcttcaagctattgtccacttagtatgatgttggctgtgggtttgtcatagatggctcttattattttgaagtatgttccttcattgcctagtctgttgagggtttttaacatgaagggatgttggatttcatcaaaagctttttctgcatctattgagaagataatttcatttttgcttttgattctgcttatgtagtgaatcacatttattcatttgcatatgttgaaccagccttgcattccaggaataaagcttacttgatcatgttttactaacttttcaatatgctgctggatttgattttctagtattttgttgaggattttcaggtctatattcatgagagatattggtctaaagtttcctttattaattgtgtctctgccagatttgggtaccaggctgatgctggcttcatagaatatattagaaaggaacccctcctctttgattttttgaataatttcagtaggattggtatcagttctttgtatgtctggtagaattcagctgtgaatccatctgagccagggctttttttggttagtaggttcttaattactgattcaatttcagaagtcgatagtggtctattcaggttttcaatctcttcctgattcagtcttggaagattgtgtccttccaggaatttacctacttcctctagattttctaatttgtgtgcatagggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggtagaacacaaaaatccctataaatttccaaaaccaaagtttgcatcccctgaaatattgccattttctactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggatcccacttctgacaccatctgtttaaaaaaaaaaaaaagccttagacaaattaaacttcacagagtttaactgagcaaagaatgatctgtgaatctggcatctggcagcctccttagccagagtaagctcagagagactccagtgcagccacgtggtggaagatttacggtcacaaaaaggaaagtgacatacagaaaatggaagtgaggtacacaaacagccagattggttacagctcaacatttgccttatttgaacatgttttgaacagttggctgcctctgactggccaaaacttggtgactggcacaagagtaggttactgtctatttaaacttccattgaggttactgttcactatgtacagagaaatctttatgccaaacttaaagtatgtaaggaagcaactttaggataaacttgatttaacaatattacatgtgaatatgtgtatatacacatgtgtctttgtgaatataaatataaatctatctatatatattctctaagatattggcacttctaataaagtggttattaaataatatttaaagataaaaacaatgaatttgattagtttagaaagcagagaaagttaacagagcaattctaacacaaatatagttgcttatcattttcagtgtgaaattagagtcaacaaacccatgattttcttagtattcactcactctatatctgtgtacaagtaattggcttattatattaaagttgctttttacttcattttatgttaactctaaaaaactgttaattgtggagtttttaaatgttgttcaatttcttttcattttaataataatattgttaatgttatcattgcttctattttctatgtgcctaacatttctctagagttgagcaggccttatcttccactttatagtgacagtaaattcatttgtgaatggggaagattttcatttatgcagatgggcttgagatagacaaatagatactcaaagagaacaacagagaaatacacaagaatatacacaatatttatactaatttatcatctatttacagaatgatagacattgccattgagttcatatgctagatacattgagtttatctatttatatatcatttaaaaaacagaatggaaatcttcctatatacagtaaacctttccctgccctctaaatcaggatattccacccataatttgcttatctcattgtgctctaatacattgacactcacagaatataggacagttgtatctacattagatggttccagttagtgatgctaatgttcttgttcagcttttcataggtgtttatttcttcaactttagagacagagttcaagatattagtcatttcttgctgctattctctgccagataagtcaatgtagtacaatgtgagagtctaggctttgcatccagatagacctgagattaaatcctgatcaactctttactagttatatggcttgtctgactgtaaagtggagatgataatatccacctccataaggttcttcttataggtgatgacagtacaaatatacagtactggccacctatcgggctttcttttttttttttttttttgagacggagtctcgctctgtcacccaggctggagtgcagtgccgcgatctcggctcactgcaagctccgcctcccaggttcacacccttctcctgcctcagcctcccgagtagctgggattacagaagcccgccaccacgcccagctaattttttgtatttttagtagagacagggtttcaccgtgttagccaggatggtctcgatctcctgacctcgtgatccgcccacctcggcctcccaaagttgggctttcaatagatatgtgtctcttgccactaccctctacaacacccacaacacccaacacccacccacattcatccccttttcatgctttccttcctgtcatctgtgaactgggcaactacataacgaagaagatttgaattatatctaaaccaaaatccagttattataatagaagtatttatttattctgagtgtacactattaattagcaaaacaaagaacataagcctaaaggctaacctatttggacctttaggtgggtaatatttgagatggtccttgaaagttgataggatttagactgaaagacatatgtagagaagcattctgtacagaggaaactgtttcaggcctaaagcacagcatagaacaaggaatgattcaatttatctggaatatagggtgtatgtggtagaagataaaactcaagaatgaatataggcctgttttgtcaaggattctgagcaccaggttaagaagtttaatttgatggaaaataggagttactgatatttcctaagcaaaggacttttgttttaggaggatttctctgtgttagcatttgggatatattagtgctgggagaaacaaaagtgaggaggtcatttagaaagttattagagtggttcaagcaaaaagtaacaaagactaactctcacacattactagtggtaatgtaagtcagtacaatctctatgacaggcaacttggcaatctctaccaacattacaaacgcacataccattttccttagccattccacttctaagaatttatcctcagatatattttcgaatgagtgaagtgatgcatataccaagttattcataatagcataaaaccttaataagaacttgaataacttacagcacattcacagtaacagaattacagcatatatatatataataagaatggggaagtcccttatgtactgattaaaacaatctctaagatgtattaaatttttaaaaattaatatattaaattgtgtaccatttgcttccatctgtgttttaaaaataaaagaaaattctggaagaatacacacacacacacacacacacacacacacacacacacacacacaaattatatctgtggcttcttgttgaatccaaaataaatattaaaagaaataaggcctaaagtcaaagtggtacctataatattggagagataacttattagaagttgatagtgggggaaaatttataaagaaagaatatggacttagaagaacagaaatttgtagaaagcctagtattgaatagtattatgccatgttatggcatgaagcagatgagtgtagatttgcgtgctttaagcagaaagaaaatttaagaaatcatgtttgcagaatataattgtcatcccaattttgccaaacaggcaccaaaatgcttggagatttattgtttcacccaaagtcacacaagtgatgacacagtaaaaacaaaaaacttctttcaaagttttatctaaagctccaatggcatagatatttagacaagtatagacaattgccttcacagctggaagtgccctcttcctccctcaccagttacccatgtaccttccctaacaaggtgaattttcttattcagcaggaaatattccctagacattagtgtttaatgaaaccatttattaaaatccgtgtaattctttcaaaattctaacatatccgaggcttgcctgattctgataataatattcaagcaaagatttttagaaaattttctttaagtcagtatgaaattttgacatttagtcaagattgaatctatggttcagatttcataacctcattaagtctccttgtgcctcttatgtgcagttctgggtacttactattatgtggaagggttaacatttttagaaaggaaacatttataaaccctagttctttttaacaagctgatttagctagttcctaagataatttactttcagaaagtataaccctttactacataacagtattaacttatagattgatttatctatcaataagttatttaagggagttataatttaaagcaataacaaaaaataatacaccaaatgtgaatctaccactgcaaaatttttaatagatacatggtttagttacagtcttttatgaacttctcaccttttatccccagagttagaaacttctatcagggtattattctcactgcagctgaaacagccctccagatgccagcagctttggcagtaggtgtcctctagtgctgactcataaaggtttgaaattttttatatttctggtctttcccccatctctgcagagatgcctttctaggtattttgcttttaattaagtctttatacagtaccttagctgactcttgtatctgggtcagtcttctcatccctgcaaagccctgggaaaactacttcactgaggttatctttgtgacaaactttacttcttaaaatttcttatttcaatcaaaacagatgtggcttgcataggcccagtcaagccctagtatattctctctaataaaggaacagttcatgggtgactttgttaatacttagcaagtgttcattctttagcattgttctttttgtcctttgagtctttactctctacttaaagaactgggtttctgaaccaaattagtactctcaaaatttgtcaacacttcacaaaccccttcattagaggggctgtcttaaaataaataaattttttaaaactgtaaatgtttgaatatttagaaacttaacaacaattaatcactagctttttcaaacccagcatttttaaatcacaaaataaatatatttgtttggtattttgataaccctctccccccagagtgaattcagccttatgagcaaatatagttaattgaaacctcttagtagtgaagctgatctttgtgattacctaaatttaattcattcacatatgagccaaaatcaaattttcatgtaggtcaattttctggaaagtttttgaagttaaacacatttagagatgtttaatttaatgctcttcctatatctattatattgtggagggagtgatttaaaacaaagaagcaaaatgcttcctgctggaaaataaagatgttttcattgcaaaattaatataacctttgtgctatgctgctgcttaaaaaaggatgtctattaattaatcatttttaaatctatcataagaagtaactgtattcattattctgtcactttctaacactaaaggaagaagaacagctgttgtctggcctctaactaactgcaatggggtctttcagaataatacagaaagaacattagaacagcatgagcaagatacacaattcaaaattaatcgaaaattggtgatctgagaactggagatgttctcatgacatgtaaatatttgttcagcagctaaagtaatagcaatgcattaaaccaatagaattacttttgacacctaacagaaatgttaattgatcatcaatctttagctcgtaataaaagggctgaacttgcagttctgaaagtatagccagaaaaattatgtgagagacataaatgttataaaaaagacaaactgctccaagctaaattgctttaaattacattgacctcatcactgtacctttgaaacctgtctctaattgagagcaattgatttaccc

SEQ ID NO: 132 - DNA, 39386 bp, Homo sapiens
cttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcctaaacagttgaaaaatgggatgaggactcatttcatccccagatgactacctataaggagtgattggctaggtgggtggctcacgcctgtaatcccagcactttgggaggctgaggcgggtggatcacccaaggtcaggagttcgagaccagccagcctgatcaacatggagaaaccccatctctactaaaaatacaaaattagccaggcatggtggcacacacctgtaatcccagctacttgggaggctgaggcaggagagttgcttgaacctgacaagcagaggttgcagcgagccgagatcgtgccaccgcactccagcctggataacaagagcaaaactctatctcaaaaaaaaaggagtgatttagggtgtccacagataaatgccctttagcctttgacataaagaatctttagttacaatgcaaacatcccagaaagaataccatattaccattatcaattattagaaattcttaaggaggctgggtgcggtggctcacgcctgtaatcccaacactttgggaggctgaggcaggcagatcaccagaggtcagcagttcaagagcagcatggccaacatggcgaaaccccatctctactaaaaatacaaaaaattagccaggcatggtggcaggcacccgtaatcccagctactcaggaggctgaggcaggagaatcgcttgaacccaggaggcggaggttgcagtgagccaagatcacaccagtgcactccaggctgggtgacaagagtgaaacttcttctcaaaaaaaaaaaacaaaaaaaacttaaggaatagttattatcatccgatatgatggcttattaagaaggaagggaacacatgataggtctgttttgaaaaggaatggggacagaacaaaatgttacacaaggtctgatcaaaagaggcttgttctggcttgtctttgtctgtcttggagtcacgggacaggtgtaaggccaaattgtgcacttcccagtcatgttaccttgggcaaataatttgaaatctgtagtttcccaatctgaaaattgagtctgatacctgttctaatttagtgttgattgatatgaacctcaaaattagaaacgtatgaaagttctttgcaaactaaaatatatgtgtgaggaattgttattattagtttagaggatggactgttgtccttagaaggcaagtctctgggtcctacagttagatgcactgggcgcttcgggaagaatttagggctatggggtactcagcaattaaaagagagggtgcttagagaagaaagaaaggacttattaatggagtttggaggctccttattatcgaaacttacacattacgtgaccagcattatgaggcagcaccccactcccaacaaatagccctctagaaccaaaagcagagtggcaggtccggggtccttttgtacatagacggcataaaaaattgactaagtcaatcctggcataactgcagaccaggccctggaatgagcaacccaccagcattatctgcatttctaggaacttgggctagaaggggaggaatggggttggaagggttaggccacatgcctctagttaaaacctgatgaacttcctagatccccagctggaaaacgtaggagttggactaaattcctctcctgcctctaatattttatgaatacagaactcaactcaaactgggtagtatctcagagattccaaatttagttccacttttctgtttgcttatcagtcgcttaccctcaccctctggtctgatacctttatcctgtacaagtggtcaaagtaggttgagtaacatgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaacttttttttgtagagacagggtcttactatgttgtccaggctggtttcaaactcctggaatcaagtgatcttcctgccttggcctccagaaatgctgggactatgcctggaatagatatgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaattttttaccatgcactcacacagctatacagctatctccagagattactctggaaactctgctataaagatgacctggtctaatgccttgatttgtttttttttttttgagacagggtctcactctcctggagtacagtggcgtgatcatgactcactgcagccttgacctcctgggctcaagcaatcctcccacatagctgggagcataggcacatagcacaccactctcggttaaatttttttttttttttttttttttgtagagatagagtctcactatgttgctcaggctggtcttgaactcctggactcaaacagtcctcccaccttggcctcccaaaatgctgggaatacaggcatgagccactgcaccaggcctaatgtcctgattttataaatcccaaaactggggcccagagagaagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctaaaaggcagtcctcagagagaagcaaggttctgcatcttaagccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctttgagaaattgcatcttatttattgattatttattgaatggtagtttcatggagtttttggtcttttttcttttttgagacagtctcactcagttgcctaggctggagtgcagtggtgcgatctcggctcactgcaacctgtgcctcccaggttcaagcaattctcctgtctcagcctcccattacaggccacaccaccatgccccactaattgtacttttagtagagatggggtttcaccatgttggacaggctgttctcaaactcctgacctcaagtgatgtgtccgccttggcctcccaaagtgctgggatttgcaactgtgagccaccacacctagcctcttggtcattctttgaaaaataaacctcagccaggcgcgatggctcacgcctgcaatttcagcgctttgggaggctgaggtggcggatcacctgaggtcaggagttagagaccagcctgaccaacatggtgaaaccccatctctactaaaaatagaaaatttaaaaagaaaatcacctgggcctggtggcgcatgcctgtaatcccagctactcgggaggctgaggcaggagaatcgcttggacccaggaagcagaggttgcagtgagccaagatcaggccattgcactccagcctgggcagcaagagtgaagtgcagtctcaaaagataaaaataaaaaaaccctctagatatatgcagctccatattctcccaccacaagggtttataaatcctgagaaagaggcaaagcagggaacacatgaccacatagttctggcaggcgtcagattaccaggctgataaaacagatggtaaagtagaagctgtccgtcgacttttccattcccctttcagctcctccactgctacttaatctcctttgcccacacagttcaatcccattttccctgatctctaaatcctggctagattattagccattaacactagcttttacaaggagactcttcaatcttgtatttctaatagtataatttcacacgtacagaaattctttaagtcatagaagtcttacagatacagaaattctgatcttcaagagtccctttgtgaaacaaactaatttatcctgacagcaggaaagatttctgggcctaaggctctgtctcgttgacccaggtcatgctattcaggtggtccatctcttggttccaagcaagactgctgctgctgaccaacctgaatatggactttagcacttgagctcaagctgcactcagatggttagacccccataaaaagcagagggtacgttttctgttatgaaaagtaaagactgagccaggcgctgtggctcacgcccataatcccagcactttgggaggcaagttgggcggatcacgaggtcaggagatttaaaccatcctgggtaacacggtgaaaccccatctctactaaaaatacaaaaaaattagccaggcgtggtggcaggcgcctgtagtcccagctacttggaggctgaggcaggagaatggcatgaacccgggaggcggagcttgcagtgagccgagattgggccactgcactccagcctgggcgacagagcaagactccatctcaaaaaaaaaaaaaaagaaaattaaatactaaaaaaattaaacattataaccctgctaaggcaggaggatcatttgagcccaggagtttgaggctgcagtgagctatgatggcactactgcaccccagcctcagtgacagagggagaccctgtttctaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggctgggcgtggtggctcaggcctgtaatcccagcactttgggaggccgaggagggtggatcacctgaggtcaaaagttcaagaccagcctggtcaacatggtgaaactccatctctactaaaaatacaaaaattagccaggcgtagtggcaggcgcctgtaatcccagctactcaggagaccgaggcaggagaatctcttgaacccaggaggcagaggttgcagtgagccaagatctcgccattgtggtccagcccgggcgacagagcgagagtttatctcaaaaaaaaagaaagaaaaaaaaagaaaaaggaatgaaatgggccaggtgcagtggctcacgcctataatcccagcactttgggagcctgaggcggacagattactcaaggtcaggagttcgagaccagcttggccaacacagtaaaccccgtctctactaaaaatacaaaaattagctgggcatggtggcacacacctgtagtcccagctactggggaggctgaggcaggaaatcacttgaacccaggaggttgcagtgagccaagcaagattgcaccactccaccccagccgggcaacaagagtgaaactctgtctcaaaaaaaatgaatgaaatggctgtgtgaggtggctcatgcctatgatcccagcactttgggaggccgaggtaggaagattgcttgaatgtagaagttcaagaccagactgggcaacaaagtgagacccccatctctacaaaaaacttaaaaagtatccaggtgaggtggcacgtgcttgtcgtcccagctactggggagactgagatgggaggattgcttgcacctgggtgttgagactgcagtgaactgtgatcttgccactgcactccagagcctgggtgacagagcaaaattcctggggagagtgaagttatgatatgctgtaaatatatggatgagccttgaagacaatatgctaagcaaaataagccagagatgaagggccaaatactgtataattacactttatgaggtacctaaagtagtcaaattcagagacaggaagtggaatagtggttgccaggggctggtggcagtggggaataaggagttattgtttaatgttgtgggaagtcaaggaccccgaatggagggaccggctggagccgcggcagaggaacataaattgtgaagatttcatcttaatatggacatttatcagttcccaaataatacttttataatttcttatgcctgtctttaatatcttaatcctgttatgttcgtaagctgaggatgtacataacctcaggaccactgtgataattgtgttaactgtacaaattgattgtaaaacatgtgtttgaacaatacgaaatcagtgcaccttgaaaaagaacagaataacagcgatttttatggaacaagggaagacaaccataaggtctgacagcctgcggagtcgggccaaaagagccatatttttcttcttgcagagagcctacaaacggacgtgcaagtaggagagatatcactaaattattttcctagtaaggaatattaatattaataccctgggaaaggaatgcattcctggcgggaggtctataaacggccgctctgggaatgtctgtcttgtgccgttgagataaggactgagatacgccctggtctcctgcagaaccctcaggcttactagggttgggaaaactccaccctggtaaatttgtggtcagactggttctctgctctccaaccccgttttctgttgtttaagatgtttatcaagaaaatacatgcaccgctgaacacaacccttatcagtggttctgcttttgccctttgccttgtgatctttgttggacctttgtcagtggttctgcttttgccctttgtcctattccctcagaagcatgtgatctttgttagaaccttattagtggttctgcttttgccttttgaagcatacgatctttgtacccactccctgttcttacccccgctccccttttgaaacccttaataaaaacttgctggtctgagactcaggtgggcatcacggtcctaccaatatgtgatgtcacccccagcggcccaggtgtaaaattcctctctttgtactgtctctatttgtcagccggccgactcttatagaaaatagaaggaacctacgttgaaatattgggggcgagttcccccaatagtttaatgggtaaagactttcattgtacaatgatgtaaaaattctgggccagacgcagtggctcacgcctataatcccagcactttgggaggctgaggcaggccgatcacttggggtcaggagtttgagaccagcttggccaacacagtgaaatcccatctctactaaaaatagaaaaattagctgggtgtggtggtgcgtgcctgtagtcccagctactcgggaggctgaggtaggagactcacttgaacccgggaggtggaggttgcagtgagctgagatcgcgccactgcactccagcctgggggatagagcgagactccaaaagttctggaaatggataatggtgatagttgtacaacaatgtaatgtacttaatatcattgatttgtacacttaaaaatggttaaaatgggcttgttccagcagctcatgcctgtaattctagcgctttgggaggccaaggcaggagggtcacttgagaccagagttcgagaccagtctgggcaacatagcaagaccctgtctctaaaaataaaaaaataaataaataaatggttaaaatgaggccatgcatgcctgtaatctcaccgctttgggaagatgaggcggtagggtcacttgtttgggaagaggaggtgggaggatcctttgaacccaggagttcaaggctgcaatgaactatcatggtgccattgcactccaacctgggtgacagagtaagacctagtctctaaaaaaataagagttaaggccagacacggtgactcacgactgtagtctcagcactttgggaggctgaggcgggcagattacaaggtcaggagtttgagaccagcctggccaacatggtgaaaccccgtcgtactaaatatacaaaaatcagctggccgtggtggcatgtgactgtaatcccagctactcaagaggctgaggcaggtgaatcgctggaacccgggagccagaggttgcagtgagccgagatcagaccactgcactccagcctgggtgacagagcaagactctgtcttgaaaaaaaaaaaaattaaaaaaagaaacatggcccagtgtggtggctcttgcctataatcccaacactcagggaggccaaggtgggaggattgcttaagcccaggagttcgagaccaggcaacatagggagaccccgtctgtacaaataattttaaaaattagccaggtgtggtggtgcatgcctgtggtcccaggtgctcaggaggctgaggtgggaggactggctaagcctgggaggttgaggctgcagtgagctatgatcacaccactgcactccagcctgggtaacacagtgagacaccccgtcttaaaaaacaaacaaacaaataaacaaatactatgcataaaacctcaaggctcaagaaacaacagtttgaaatagttagatgtgtgttttttaattttcatgtcttatcttttctgttttttgtttttttttttttttttttagagatgagatcttgctctgttgcccaagctggtatcgaactcctcctgggctcaagcaatctcctgcctaggactccctcctaacagctggaactacaagcatgaaccactgcacccagcta

SEQ ID NO: 133 - DNA, 9463 bp, Homo sapiens
cttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagcta

SEQ ID NO: 134 - DNA, 19719 bp, Homo sapiens
acactgcctattagtctcatgttctaatcagtcactatcagccatttctgtttttttccaagatttcattctgactcttaacacctttagatttgctctgaatcaattctttcctttgagcaaggaagacataacatttctttcttctaatgtaaaaagagtcctgtgaggcggggtgcagtggctcatgcctgtaatcccagcactttgggaggccaaagcgggtggatcacttgaggtcacaagttcgagaccagcctgaccaacatggtgaaaccctgtctctactaaaaatacaaaaatttgctaggcgtggtggtgggcgcctgtaatcccagctactcgggatgctgaagcagaagaatcacttgaactggggaggcggaggttgtagtgagctgagatcgcgctccaacctgggtgacaaagcgagactccatctcaaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatcaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatctaaagctggggtccctaacccccaggccatgggcctgtaccagttcatggcctgttaggaaccgggccaccacaacaggatgtgagtggtgggtgggcaagcattaccagtgagctctgcctcctgtcagatcagcagtggcattagagtcacgtagcatgaaccttactgtgaactgcacatgtgaggggtctaggctgcgcaccctttatgataatctaatgcctgatgatctgaggtggaaccatttcatcctcaaaccatccccaccccgctggtctgtggaaaaattatcttccacgaaaccggtccctggtgccaaaaaggttgaggactgccgatctaaagggagcacacaaagtaatgactcttggcagggtacagtggctcatgcctataatcccagcactttgtttgggaggctaaggtgggaggaccccttgtggccaggagttcgagaccagtctgggcaacatagtgagaccctatctctaaaaaagttaaaaattagctgagtgtagggtgcacacctgtggccctgatcctcctgcatcagcctcgcgagtggctgggactccaggtgcgtgccaccatgcccaactaagttttgtatttttttgtagagacggggtctcaccttgttgcctagactagtctgaaactgctaggctcaagcgatctgcctgcctcatcaaattgtatggtttaacaggattaattttatagtatgtaaattcaagctcaataaagctgttattgaaaaagaatcctctggctgggagagtggctcatgcctgtagttccaacactttgggagtctgaagagggtgcatcacttgagcccagaagtttgagaccagcctgggcaacacagcaagaccttgtctttacaaaaattagctgggtatagtggtgtgcacctgtagttccagctactcgggagagtgaggtggaaggattgcttgagctcaggaaggtaaaggctgcagtgagccatgattgtaccactgtgctcagcctgggaaacagagtgagaccctgtcaaaaaaaaaaaaaaaagaagaagaaaagagagagagggaaggggaggggaagggggaagagaggaaagggagacatgaaggaaggaaagggagaaggaaaggaaggaaaaaaaggaagggaggaaggagaaaagaaaaagaggctggacacggtggctcacgcctgtaatcccagcactttgggaggccgaggtggacagatcacgaggtcaagagatcaagaccatcctggccaacatggtgaaccccgtctctactaaaaatacaaaaattagctgggtgtggtggcgcgcacctgtagtcccagctactcgtgaggcagaggcaggagaatcacttgaacccaggaggcggaggttgcagtgagccgagatcacgccaccgcactccagcctgggcgacagagcgagactttatctcaaaaacaaagccaggttgtgtggaaatcctgtggctgtccacagctgtctggcgggtgcctccacagcaggcacagaatgtgcctgtgcctccaaggatagactgagcccagggaaggacttcttgccaagtggatgcaaaggcacaactagcaggccaggcaaccctgtcagccaggtgtggaggcatgcacctgtgattccagctaccctggaggctgaggcaggggaattgcttgaaccaggaagatggaggttgcagtgagcagagatcacgccactgcactccagcctgggtgacagagcaagactctgtctccaaaaaaagaaaaaaaaaaaaaaggaatgggtgacaactgctgttagtttctgcacaccactgggcccatctgaacagtaatcctacaaagagtcatgggaaatagagtcttgtggaagatgtgcacattttgtttcataagctaatttcttggtcaccttctttccctctttgtcttacagagtgaagaatgatgaacttgtgaaagttcaggtatgggtgggctgagtgtggagtgggagggtagagccagcccaagggaaaagggcagaatgctgggtcaggagtttgatgcactttccctgttaggtgcactttccctgttagcattgagataggagctgccttattggtaactagtggccctaaaccacttggttatacctaagttatatcagatctcaagtgattgtatgttcctgtgaggctcttcctagttatagttagtattttataattttgtgagattatttttagtacgtagaaaggggattgcctagatgctaatggtgcttcagcccatgaactgggagctctagcacatgaatagtgggtaatgatgggaagtagccacattcccgttattaacccctgccttccctgttagcttcctgcttacatgcttcaggaattgcctgggcactccacttttctggagtttcagggaagaccttagatagctgcttgttgtaccgatttaggttttccaggacaatctggtctctctttgcaccaatctggtggatgatctggacttcatctgtgaacagacaaagaaacaatgagtcccctataacctccctatttcctttctccctgggttcctaatcaccaggatcagacccaacttccttttgccctaatctaagcccctaggatccatgactgccatactctggggcatcccttgaaggtgaccattgcttagaaatatcacagtgataaatcactatagtgtctgtgggggaaaaaaaaaagaaaaaggaaatgtcatagctagtcacctcattagaggcctgggagccaaggatggtgatttccttcctaaggcagaacctatggccgggtgtggtggctcacacctgtaatctcagcactttgggaggccgaggtgggtggatcacatcatcaggagttcgagaccagcctgggcaacactgtaagacccccgtctctacaaaaaatacaaaaattagctgggtacagctactcgggaggctgaggcaggagaatcagttgagcctgggaggtggaggttgcagtgaagatagcaccactgcactccagcctaggcaatgggagtgaaaccatttcaaaaataagaaaagaaccggctgggcaccatggctcacgcctgtaatcccagcactttgggaggctaaggagggcggatcacaaggtcaagagattgtgaccatcctggccaacatggtgaaaccctgtctctactagaaatacaaaaattagctgggcgtggtgatgcgcgcctataatcccagctatttgggaggtggaggcagaggttgcagtgagccaagattgtgtcactgcactccagcctggcgacagagcaagactccgtctcaatagaaaagaaaacaaaagaaaagaacctatgtaaccacttagaggccttatcccttataaaaagctagatactaaaaaagaggcacctaattaatctcatcagtcatgaatacttagagtaattttgttaaacactttgagaagactttcagctgcagcagtttaggaacaagatggggcttgggaagaagaaacagcttggaacacgaagacctagattgagtatcctggaagcccaggcatctaagggacagcagtagggacagggaaggtggcaaacatttactgaacaccttaaacagacattgagcaagaagcattacagatgctttctcatctactctactcaaagtgcatttttgttaacatcacttcacaaataaggtacttgtggctcagaggaattatataatttactgaaggttactaaaaaaatactgagccaggatttaaacccaaatgtgcctgactccaaagccctgattttttccaacatagcaccttggtgggagaatatctcgaagtgggagaatatctcgaagtgagagaagggagaagggtagatagagaagagatggattgttcccaaagtcttgccaactttacagttccacccttcattgcctctttagtaagatagagggatagagaaagcggggagagagagcagttccctccctattagttatcactccccgacccaactcctgtgctagtgtgggtgctgggtcatgaacatgaaaacctgggtcatccagggcctcttgtccatacccacaactgtttccagcccccagcaatcttccaccttcctggcccatgtccccgtgtgcccctaccacaggggcccagctctattaccaaagtaaatctcctgttcaaaggtgttgtctgtggagtaggcaaactttccagctcggggagtcacctggcgaaagtagctctgggtttggggctgggagaggctcgtcttttcatggatatcctcagtgctcttgttgccaggcatgatctcaactgtctctgcttgttggaagtaactgggcaatcttggcaggggtgagaaaggagggaaaagggggaaagagtaggaggtggatccccctttccattaaatccacagctcgttccctttcctctttaagctcagctcctatacacgtgagcattgcagaacaccaatgtttaacttttagccttgtccccatggtgccagttgaatgtggagctgccagaagggcctgtctacagctgtcctgcctggctactaaaggatccatgccttctgcagccaccaagcagcagggcagagtggcggtgctccagcataacccttttttaacattcgtactcttagaggcggcatggccttggggaagggatcccacctccttcgtcatctcactctgtctattctgtgtgtggttatttaatgtccatccacctggtggtggacaggctgtaagctccttaaaggtacatatctgtgtctgttgcttttacattgtattcccagcactttgcagagtgcctggaaagtagcaagaacataatttatatttgtccaataaatgaataaataaatggatttccactgatttttagttcactcttggaaatcagggatagtgtaatagctccagtcttccctctagctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagcta

SEQ ID NO: 135 - DNA, 51742 bp, Homo sapiens
accacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcctaaacagttgaaaaatgggatgaggactcatttcatccccagatgactacctataaggagtgattggctaggtgggtggctcacgcctgtaatcccagcactttgggaggctgaggcgggtggatcacccaaggtcaggagttcgagaccagccagcctgatcaacatggagaaaccccatctctactaaaaatacaaaattagccaggcatggtggcacacacctgtaatcccagctacttgggaggctgaggcaggagagttgcttgaacctgacaagcagaggttgcagcgagccgagatcgtgccaccgcactccagcctggataacaagagcaaaactctatctcaaaaaaaaaggagtgatttagggtgtccacagataaatgccctttagcctttgacataaagaatctttagttacaatgcaaacatcccagaaagaataccatattaccattatcaattattagaaattcttaaggaggctgggtgcggtggctcacgcctgtaatcccaacactttgggaggctgaggcaggcagatcaccagaggtcagcagttcaagagcagcatggccaacatggcgaaaccccatctctactaaaaatacaaaaaattagccaggcatggtggcaggcacccgtaatcccagctactcaggaggctgaggcaggagaatcgcttgaacccaggaggcggaggttgcagtgagccaagatcacaccagtgcactccaggctgggtgacaagagtgaaacttcttctcaaaaaaaaaaaacaaaaaaaacttaaggaatagttattatcatccgatatgatggcttattaagaaggaagggaacacatgataggtctgttttgaaaaggaatggggacagaacaaaatgttacacaaggtctgatcaaaagaggcttgttctggcttgtctttgtctgtcttggagtcacgggacaggtgtaaggccaaattgtgcacttcccagtcatgttaccttgggcaaataatttgaaatctgtagtttcccaatctgaaaattgagtctgatacctgttctaatttagtgttgattgatatgaacctcaaaattagaaacgtatgaaagttctttgcaaactaaaatatatgtgtgaggaattgttattattagtttagaggatggactgttgtccttagaaggcaagtctctgggtcctacagttagatgcactgggcgcttcgggaagaatttagggctatggggtactcagcaattaaaagagagggtgcttagagaagaaagaaaggacttattaatggagtttggaggctccttattatcgaaacttacacattacgtgaccagcattatgaggcagcaccccactcccaacaaatagccctctagaaccaaaagcagagtggcaggtccggggtccttttgtacatagacggcataaaaaattgactaagtcaatcctggcataactgcagaccaggccctggaatgagcaacccaccagcattatctgcatttctaggaacttgggctagaaggggaggaatggggttggaagggttaggccacatgcctctagttaaaacctgatgaacttcctagatccccagctggaaaacgtaggagttggactaaattcctctcctgcctctaatattttatgaatacagaactcaactcaaactgggtagtatctcagagattccaaatttagttccacttttctgtttgcttatcagtcgcttaccctcaccctctggtctgatacctttatcctgtacaagtggtcaaagtaggttgagtaacatgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaacttttttttgtagagacagggtcttactatgttgtccaggctggtttcaaactcctggaatcaagtgatcttcctgccttggcctccagaaatgctgggactatgcctggaatagatatgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaattttttaccatgcactcacacagctatacagctatctccagagattactctggaaactctgctataaagatgacctggtctaatgccttgatttgtttttttttttttgagacagggtctcactctcctggagtacagtggcgtgatcatgactcactgcagccttgacctcctgggctcaagcaatcctcccacatagctgggagcataggcacatagcacaccactctcggttaaatttttttttttttttttttttttgtagagatagagtctcactatgttgctcaggctggtcttgaactcctggactcaaacagtcctcccaccttggcctcccaaaatgctgggaatacaggcatgagccactgcaccaggcctaatgtcctgattttataaatcccaaaactggggcccagagagaagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctaaaaggcagtcctcagagagaagcaaggttctgcatcttaagccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctttgagaaattgcatcttatttattgattatttattgaatggtagtttcatggagtttttggtcttttttcttttttgagacagtctcactcagttgcctaggctggagtgcagtggtgcgatctcggctcactgcaacctgtgcctcccaggttcaagcaattctcctgtctcagcctcccattacaggccacaccaccatgccccactaattgtacttttagtagagatggggtttcaccatgttggacaggctgttctcaaactcctgacctcaagtgatgtgtccgccttggcctcccaaagtgctgggatttgcaactgtgagccaccacacctagcctcttggtcattctttgaaaaataaacctcagccaggcgcgatggctcacgcctgcaatttcagcgctttgggaggctgaggtggcggatcacctgaggtcaggagttagagaccagcctgaccaacatggtgaaaccccatctctactaaaaatagaaaatttaaaaagaaaatcacctgggcctggtggcgcatgcctgtaatcccagctactcgggaggctgaggcaggagaatcgcttggacccaggaagcagaggttgcagtgagccaagatcaggccattgcactccagcctgggcagcaagagtgaagtgcagtctcaaaagataaaaataaaaaaaccctctagatatatgcagctccatattctcccaccacaagggtttataaatcctgagaaagaggcaaagcagggaacacatgaccacatagttctggcaggcgtcagattaccaggctgataaaacagatggtaaagtagaagctgtccgtcgacttttccattcccctttcagctcctccactgctacttaatctcctttgcccacacagttcaatcccattttccctgatctctaaatcctggctagattattagccattaacactagcttttacaaggagactcttcaatcttgtatttctaatagtataatttcacacgtacagaaattctttaagtcatagaagtcttacagatacagaaattctgatcttcaagagtccctttgtgaaacaaactaatttatcctgacagcaggaaagatttctgggcctaaggctctgtctcgttgacccaggtcatgctattcaggtggtccatctcttggttccaagcaagactgctgctgctgaccaacctgaatatggactttagcacttgagctcaagctgcactcagatggttagacccccataaaaagcagagggtacgttttctgttatgaaaagtaaagactgagccaggcgctgtggctcacgcccataatcccagcactttgggaggcaagttgggcggatcacgaggtcaggagatttaaaccatcctgggtaacacggtgaaaccccatctctactaaaaatacaaaaaaattagccaggcgtggtggcaggcgcctgtagtcccagctacttggaggctgaggcaggagaatggcatgaacccgggaggcggagcttgcagtgagccgagattgggccactgcactccagcctgggcgacagagcaagactccatctcaaaaaaaaaaaaaaagaaaattaaatactaaaaaaattaaacattataaccctgctaaggcaggaggatcatttgagcccaggagtttgaggctgcagtgagctatgatggcactactgcaccccagcctcagtgacagagggagaccctgtttctaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggctgggcgtggtggctcaggcctgtaatcccagcactttgggaggccgaggagggtggatcacctgaggtcaaaagttcaagaccagcctggtcaacatggtgaaactccatctctactaaaaatacaaaaattagccaggcgtagtggcaggcgcctgtaatcccagctactcaggagaccgaggcaggagaatctcttgaacccaggaggcagaggttgcagtgagccaagatctcgccattgtggtccagcccgggcgacagagcgagagtttatctcaaaaaaaaagaaagaaaaaaaaagaaaaaggaatgaaatgggccaggtgcagtggctcacgcctataatcccagcactttgggagcctgaggcggacagattactcaaggtcaggagttcgagaccagcttggccaacacagtaaaccccgtctctactaaaaatacaaaaattagctgggcatggtggcacacacctgtagtcccagctactggggaggctgaggcaggaaatcacttgaacccaggaggttgcagtgagccaagcaagattgcaccactccaccccagccgggcaacaagagtgaaactctgtctcaaaaaaaatgaatgaaatggctgtgtgaggtggctcatgcctatgatcccagcactttgggaggccgaggtaggaagattgcttgaatgtagaagttcaagaccagactgggcaacaaagtgagacccccatctctacaaaaaacttaaaaagtatccaggtgaggtggcacgtgcttgtcgtcccagctactggggagactgagatgggaggattgcttgcacctgggtgttgagactgcagtgaactgtgatcttgccactgcactccagagcctgggtgacagagcaaaattcctggggagagtgaagttatgatatgctgtaaatatatggatgagccttgaagacaatatgctaagcaaaataagccagagatgaagggccaaatactgtataattacactttatgaggtacctaaagtagtcaaattcagagacaggaagtggaatagtggttgccaggggctggtggcagtggggaataaggagttattgtttaatgttgtgggaagtcaaggaccccgaatggagggaccggctggagccgcggcagaggaacataaattgtgaagatttcatcttaatatggacatttatcagttcccaaataatacttttataatttcttatgcctgtctttaatatcttaatcctgttatgttcgtaagctgaggatgtacataacctcaggaccactgtgataattgtgttaactgtacaaattgattgtaaaacatgtgtttgaacaatacgaaatcagtgcaccttgaaaaagaacagaataacagcgatttttatggaacaagggaagacaaccataaggtctgacagcctgcggagtcgggccaaaagagccatatttttcttcttgcagagagcctacaaacggacgtgcaagtaggagagatatcactaaattattttcctagtaaggaatattaatattaataccctgggaaaggaatgcattcctggcgggaggtctataaacggccgctctgggaatgtctgtcttgtgccgttgagataaggactgagatacgccctggtctcctgcagaaccctcaggcttactagggttgggaaaactccaccctggtaaatttgtggtcagactggttctctgctctccaaccccgttttctgttgtttaagatgtttatcaagaaaatacatgcaccgctgaacacaacccttatcagtggttctgcttttgccctttgccttgtgatctttgttggacctttgtcagtggttctgcttttgccctttgtcctattccctcagaagcatgtgatctttgttagaaccttattagtggttctgcttttgccttttgaagcatacgatctttgtacccactccctgttcttacccccgctccccttttgaaacccttaataaaaacttgctggtctgagactcaggtgggcatcacggtcctaccaatatgtgatgtcacccccagcggcccaggtgtaaaattcctctctttgtactgtctctatttgtcagccggccgactcttatagaaaatagaaggaacctacgttgaaatattgggggcgagttcccccaatagtttaatgggtaaagactttcattgtacaatgatgtaaaaattctgggccagacgcagtggctcacgcctataatcccagcactttgggaggctgaggcaggccgatcacttggggtcaggagtttgagaccagcttggccaacacagtgaaatcccatctctactaaaaatagaaaaattagctgggtgtggtggtgcgtgcctgtagtcccagctactcgggaggctgaggtaggagactcacttgaacccgggaggtggaggttgcagtgagctgagatcgcgccactgcactccagcctgggggatagagcgagactccaaaagttctggaaatggataatggtgatagttgtacaacaatgtaatgtacttaatatcattgatttgtacacttaaaaatggttaaaatgggcttgttccagcagctcatgcctgtaattctagcgctttgggaggccaaggcaggagggtcacttgagaccagagttcgagaccagtctgggcaacatagcaagaccctgtctctaaaaataaaaaaataaataaataaatggttaaaatgaggccatgcatgcctgtaatctcaccgctttgggaagatgaggcggtagggtcacttgtttgggaagaggaggtgggaggatcctttgaacccaggagttcaaggctgcaatgaactatcatggtgccattgcactccaacctgggtgacagagtaagacctagtctctaaaaaaataagagttaaggccagacacggtgactcacgactgtagtctcagcactttgggaggctgaggcgggcagattacaaggtcaggagtttgagaccagcctggccaacatggtgaaaccccgtcgtactaaatatacaaaaatcagctggccgtggtggcatgtgactgtaatcccagctactcaagaggctgaggcaggtgaatcgctggaacccgggagccagaggttgcagtgagccgagatcagaccactgcactccagcctgggtgacagagcaagactctgtcttgaaaaaaaaaaaaattaaaaaaagaaacatggcccagtgtggtggctcttgcctataatcccaacactcagggaggccaaggtgggaggattgcttaagcccaggagttcgagaccaggcaacatagggagaccccgtctgtacaaataattttaaaaattagccaggtgtggtggtgcatgcctgtggtcccaggtgctcaggaggctgaggtgggaggactggctaagcctgggaggttgaggctgcagtgagctatgatcacaccactgcactccagcctgggtaacacagtgagacaccccgtcttaaaaaacaaacaaacaaataaacaaatactatgcataaaacctcaaggctcaagaaacaacagtttgaaatagttagatgtgtgttttttaattttcatgtcttatcttttctgttttttgtttttttttttttttttttagagatgagatcttgctctgttgcccaagctggtatcgaactcctcctgggctcaagcaatctcctgcctaggactccctcctaacagctggaactacaagcatgaaccactgcacccagctactggtgtattgtttcagtagtctttttaaaaaatgttaatatcttggtaaaaaatatatttatactgttctctaacctgcttttttcatcagtgtgatggaaaaatgctcatcatatattcttctgctatataactttagatgtctacactgatttcatttatgacatcacaattaaactggttaaaccaaattcatattgctcacttgtttctaattttttctctattaaaatgatatgataagcatccttgtagccaaatatttacacacattcattaaggtttacttaaaagaaattcctagacgtggagctgagtcaaagagaagggatcttttaagtatttttgcactgattgccatgaaaaggtcataccagtttatacattcatcaatatatgagtttcttttctaaatcttcttcaacatcatgtgagagacagttaaagcatagttgttcagagcccaggcttgagaatcagatttcaaaggtatgaaccctctccctttttcttttccttttttttttttttttctgaggagtcttgctcagtcgcccaggctggagtgcagtggcccaatctcggctcactgcaagtgtgtccagaattggtggattcttggtctcactgacttcaagaatgaagccgtggaccctcacgggagcattacagctcttaaaggtggcatgtccagagttcgttccttctgatgttcggatgtgttcggagtttcttccttctggtgggttcatggtctcgctggcttaggactgaagctgcggaccttcgtggtgagtgttacagctcttaaggcggcgtgtctggagttgttcgtttttcccggtgagttcatggtctcgctggcttcaggagtgaagctacagaccttggtggtgagtgttagagctcataaaggcagtgtggacgcaaagagtgagcagcagtaagatttattgcaaagaacgaaagaacaaagtttccacagtgtggaagggggaccccagcgggttgccactgctggctagggcagcctgcttttattctcttatctggccccactcacatcctgctgattggtagagcccaggggtctgttttgacagggcactgattggtgcgtttacaattcctcagctagacacaaaagttctccacgtccccaccagaatagttagatacagagtgttgacacaaaggttctccaagtccccaccagagtagctagatacagagtgttgattggtgcattcacaaaccctgagctagacacagggtgctgattggtgtgtttacaaaccttgagctagatacagagtgccgattggtgtatttacaatcccctagctagacataaaggttctccaagttcccactagactcaggagcccagctggcttcacccagtggatcgtgcactggggctgcaggtggagctgcctgccagtcccgcaccgtgagcccacactcctcagcccttgggtggtcaatgggactgggctccgtggagcagggggcggcgctcgtcagggaagctcaggctgcacaggagcccacggaggcggggggaggctcaggcatggagggctgcaggtcctaagccctttcccgtgggaaggcagctaaggcccagcgagaaattgagcacagcgccagtgggccggcactgctgggggacccagcacaccctccgcagccgctggcccaggtgctaagcccctcattgcccggggctggcagggccagctggcggctccgagtgtggggcccaccaagcccatgcccacctggaactccagctggcccgcaagtgcggaacgcagcctcagttcccacttgcgcctctccctccacacctccctgcaagctgagggagacggctccggccttggccagcccagaaaggggctcccacagtgcagcggtgggctgaagggcttctcaagtgccgccaaagtgggagcccaggcagaggaagtgctgtgagggctgccagcacgctgtcacctctcacaagctccacctctggggttcacgccattctcctgcctcagcctctggagcagctgggactacaggtgcctgccaccatgcccagttaatttcttgtatttttttttagtagagatggggtttcactgtgttagccaggatggtgtcgatctcctgacctcatgatccacccgcctcagcctcccaaagttctgggattacaggtgtgagccaccgcgcccatcccctttttctttttagagacagggtcttgctatgttgtccaggttggtgcgaaactcctggccttaagcaaccctgccacctcagcctccaagtaaactgggattacaggcgtgagccatcttgcccaacttccactttctagctgtgtgatcttcagaaaatcagttaaattctctgggccttaatttactgatagggttcttgtaagtattaaccattagctactattgagaggtgaagaccgctgggcttctgggttgggtggggacttggagaacttttttgtctagctaaaggattgtaaatgcaccaatcagcactctgtgtctagctaaaggtttgtaaacgcaccaatcagcactgggtaaaaacgaaccaatcagcactttgtaaaacgaaccaatcagcactctgtaaaatggaaaatcagcgctctgtaaaatggaccaatcagcaggacatgagcagggccaaataagggaataaaagctggtcaccccagctagtagtggtaacctgcgtgagttccgctccaggctgatggaagctttgttcttttgtacttcacaataaaccttgctactgctccttctttgggtccatactgcatttcagagctgtaacaccgtgaaggtatacagcttcactcctgaagccaagaccatgaacccactgagaggaacaagaaaaacaactctggacctgctgcctttatgagctgtaacactcaccttgaaggtctgtggctttactcttgaagtcggtgagaagcgagaccatgaacccaccagaaggaacacattccggacgcatctgaacatcagaggaaacaaactccagacacactacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaaggtaattagaactgacagggaattgtatgattaatgacgtgggacatgagagatttggaacgagataaaaaggcttaccttgaggacagccttattaggagcagaggcaaacacaggttttgtgggtttgaagcctacacatttatagctttctctaattacacaggtaggaaattataaaatcaggtacaagggcttggcaggggcctaaagcttaagtgatgaaaaaaaaaaacaccacacctctggtgaaaccaatagcttacgaaaaagtagaaaaaagcgcgatgcatggggagctccggtagtcctttgaggtatttgagaggctgagtcaggaagatggcttgagcaccaggagttggaggtttgtaagtgcagtgatggtaaactgccgctgtactccagtctggcaatgtagtgagaccctgtctctcaaaaaaaaaaagtaacccttgcctgactgggacaataattgagaaaccagtaaaacaaaataataactattagccgggcgcggtggctcatgcctgtaaatcctagcattttgggaggctgaggcgggcggattacaaagtcaggagtttgagaaattactacctattaccccatttggctatttttacacttgtaaggaatgaagctcagaggtcacacagctagtaagaagccagcacccttcgatgtgggattgatgtggaggataggcatatacagagaacacaaaagcaaaacaccatggtgcagattttgaaagaaaagccctaagattagtaatgagtgtgaattattcaacaaagtgatcaaaactaactccagctctgcattcctcttcgccatcaggagtttggagcctggagactgctagctgcctggttctttaagaaccagccctggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccaggtgactcacctccgctaattgttccgtgttcgttcgcctttcactttgtgtgtctcccccgccccacgcttttcgcttatgtgtatgcccccccgccgcgcccccgggctatattgcccaggcaggtttcgaattcctggtctccagctatcttcccgcctctgcctccctaagagctgggattacagggtgagccaccgcgcccggcactttgaggggagttacactttttttttttttccgtccctgcccttttcacacgaagaagggatgtagcttccaaccttccggaggttagtgtaaagaaacaggaatggaatggaaagctgattggggaagtgtccctgccgctccaaaactgagaggtccctcaaacctagtgctcagttaaaagacattgtaagggccaggcgcagtggctcacgcttgtaatcccagcactttgggaagtctcggcgggcagatcacgagatcaaaagattgaggccatcctgactaacacggtgaaaccccgtctctactaaaaatacaaaacagtagctgggcgtagtagcgggcgcctgtagtcccagctactcgggaggctgaggcaggagaatggtgtgaacccgggaggcagagtttgtagtgagctgagatcgcgccactgcactccagcctgggcgacagagcgagactccgtctcaaaaaaaagacattgtaaggaaaggaaaaagacacttatattaaaaacaaaacaggccgggcgcggtggctaacgcctgtaatcctagcgctttgggaggccgaggccggcggatcacctgaggtcaggagttcgagaccagcctggccaacatggtgaaaccccatctctactaaaaatagaaaaattagccaggcgtggtggtgcatgcctgtagtcccaactacttaggaggttgaggcaggagaatcgctggaacccgggaggcagaggttgcagtgagctgagatcatgccattgcactccagcctgggggacaagagtgactctatcttaaaaaaaaaaaaaaaaaattcaggtagtttcaattttttaatgttcttatttatgtattgactaggaagccacttttttttttttttaaataagaattccgactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccccgctggctggctatgatctccctgttaccattccaggagagcagccgcgtccctatgcatggcaggaccaggtactattgtggcctctcctcttggcctcgaatggtatctttgtcatcagtgagcaagtccccaaagaccacggtcttgtccattgtcaggataattcactccacaagctggggctccaggtgctgccctacccagcggtgcttctcacccacacagtggtcatactttggcaggggctggtgcagtgtgaagacctcggtgttttgcatgtgcttcatctcttgcaaggtcctccggggttgggcttcaagactagggaaaagcctgggcttcacacccgtgggccactttatccaccaggtccggcagcagggtgaggtactgcttccagaccaggaagctgcggtgctgctgcagtgtcacatgcagctccctgagaaggggcggctgaagccccgcaggaggccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttgaattcgcacagtatgttaagatttatgtaaattagcatttacaataggaaaacctcttcctgtcaaatggaaatttgaggttactggatacttttatattacataaagagcaatcagccagtgtaaaaatgaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagcaacatattcatctgctctgggcaacaatttgtcttaacttacaaagttaaatatgttattctacttgtacatgtgcaccaggaggcatattccttataagaggccagatgagcagtctggattaatttaaaaaaagagcaaagtcaactggaaacagtccaaatgtccatcaacaatagaacagattaataaattgaggtatatttccagcagtcaaagtgattgaactacagctacaagaatcaacatctatcaagatatacaaaagaaaagaaaaaaaaagaatcaacatggatgaatctccaaaccactgttgagtgaaacagtcaaaccctaggagaacacattcagtatcattccatttagatacaattcaaaaactaggcaaaataaaatattaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattttttttttttttttttttttttttgagacagtgtctcgctctttcgcccaggctggagtagtggcacaatcttggctcactgcaacctccacctcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctggggttacaggcgtgagccaccggacccagcctgcattattactatttaattttgtgtgaaacacaaaacctttaatgtaaatgataaaaatatcagtaagtggagtcattcagaatgagtagccttttgagtctgtctccgttgagtaagtgcattctgttgagtgcactggagaggaatttgtgctcttctatgtagcagtctttctttttgtttcttggtggtgcaccattaaatggattcattcaccagttaaaggacatttgggttgtttccagtctttggctacaacgagtaaagtcactataaacacttgccagaggtttctggacgaacaggttttcatttctcgtgggtagatacctaggagtgggattgctgggtcacatgtgtggtaagtatatgtttaacttaaaccatccaactgtttcaggaatagcttagttttgcattttgttttgtttcttcccaagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggttagttcttctttcagatttatgggctatgatgtatcaggtctcttcttaaatggtctgggttttcacagaagttagctcattcatgacagccattccctaccccaacacacactaccttttttagtcacttcttatagacagtttctttttttgagatggagtctcactctgttgccaggctggagtccagtggtgcgatcttggctcactgcaacctccacctcccaagttcaagtgattcttgtgccccaccctcccgagtagttgggattacaggcacctgccaccatgcttggctaatttttgtatttttagtggaggcggggtttcacaatattggtcaggctggtcttgaactcctgacctcaaatgatccacctgctttgacctacccaagtgctggattacaggcatgagccactatgcccagcctaatatttgtatttttttttttttaagtagagatggggtttcgccatgttggccaggctggtctcaaactcctgacctcaagtgatctgcccaccttggcctcccagagtgctggaattacaggcatgagccaccacacctggcctcttatagacagtttctattcaattctatattactatatttcctgctagtaaagagattcgtagttgttattatgcaattttaaattccagtatttttttttttttttttttgagatggagtcttgctgtgtcacccaggctggagtgcaatggcatgatctcggctcactgcaaactccacctcccaggttcaattgattcttctgcctcagcctcccacgtagctgtgactacaggcacgtgccactactgcccggctaattcttgtatttttagtagagatgtttcaccatgttggccagactgatctcaaactcctgacctcaaatgatccacccgcctcagcctcccaaactgttgggattacaggcgtcagccaccactcccggccatgagatgatgtacttgttgatgatgactcagtttagttatgacagtgggaatgggtggctcaggtgggagacagaaaaagatcatgggagatacgagattaaggaactgagaaaccagagaataattgatagatcttccacatggttatcaccaagagtggtgatggacaaattgtggaaaggaagagatagaggggaggtaaattctcaaagttgcaaatctgggtaaatggtagaacctagattcagactcaggttcaactaacttccagggtggacacaactcaccatattccactgtttgtggaatcattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtat

SEQ ID NO: 136 - DNA, 96912 bp, Homo sapiens
ctttagttgtaattggttgagggttgggcaattcgaagttatgataggctgctaaaagtgtctgttaagctaactggcaagagacgtgacggttaaggttgattcacgcttgtgcacagtttggttgcgcagtagaaagcaaaggaggggcagacgctcacattcgtggttacccgggaagggttaagtctttgttgtagagttttctctgtaaacttttccacttctccagctcacttcctgcaaggagaagcttatctctgctagctttattcataggggtagtacttacaaaacaccaacattagaggttgtgtttaagaagtgtttccaagccctggggagaaaggtatcagagagataaaaatgtccccttcttttctttggtctcaatgcatccaatttcattgaagttctttccaggagcctcaatgctaaagggcaaagcgcaaactttcatttagcagaaatcagtcaacttcggttgcaattataaatgtcgtcaataaactgaagtggcgtattgagagttctccagcttccagatccactcctggctgacccctgccaattgaccagacagccattagcaactttttttttttttttttttttctgtgagacggagtttctctcttgttgcccaggctggagtgcaatggtgctatctcggctcatcgcaacctacgcctcccaggttcaagcgattcttctgccttagcctcccgagtagctgggattataggcatgagacggggtttctccatgttggtcaggctagtctcgaactcccaacctcaggtgatccgcccgcctcggcctcccaaagtgctggtattacaggcgtaagccaccgcgcccggccagcaactttctaataagcgggccacattataccctttatgatgctctggaaatgagaattctgctttcccccacctctcactgccactttgtttttctgttcagcagttcttaaatagccctactagctgtgtgtcagatactttaaaagcttctctctctctctctcttttttttttctaaacctcttcctagcagtctaaattagggccattgaatgaattgccgggttgtgtgtgtgtgtgttttttttttttcctcacttggcacaatgcacaagaataaatgattgcattttttattcacttgggtacaaatcacagtaggcatttttgagaaatctaatgttgctataaaaactcttgtgctcctagaaatatattcatcattagctttttgtttttccttttttttcacccacttttcctgctcctaaataacaaaatgctggtctgattactctttcagtttctaaatcagatttaaatgtactttctcacaaccccacctatgatacatatacccatgggccatgaaacaacacccagggatagtttaagacactgtcaggccgtgcggtggctcatgcctgttatcccagcactctgggaggccgagccgggcagatcacctgaggtcaggagtttgagaccagcctgactaacatggtgaaacccctgtctctgcagatggtgccactgcactccagcctgggcaacagagtgagactctgtcttaaaaaaaaaaaaaaaaaaagacactgtcaaggaggcattcacctcaaggatgtggactttggaaatgtgctttgtctctttcttctttctgctaaccctttgtctcatatttcttctatttactaacctccttgttctttgcagagcaagctacaaagagtctaaaactgtatggtttattattcagaaaaatattgtcttttttctagcctatatttttagtcaagtttaaataaagtacatacttctatcaccagactaagcagaaattattcctccagtaactatacataacaataaagtgccttttcctagttattttccggaactttcctccccctcctctcttcctcaccttccaatttagaaataacctcccattcaattcaatgactcacaaaaagcctgtgaaaggaaagtggaaaagccaaaataacttagagatgtctgaatcattcagctgaaggaaagatcagacattgaccatgataagatagacgccaagacataaggcaagcctgagctaacatcccataacatgtgaagtaatgcaaatgtgaagatgccccaagaaaaagcaaataccaatatgtccttttacacagccttttaatatatcaccagcagcttgcttctctctagtcttggcagtgtgccatgctaccaattttagagcaagttagaagacaattaatgtcctgacagataggaaacaataacgtcataggaggacatgaccattattatggtactttgggtaataatggctcttgcacagccatagtgactaggtgccatagaaaacatagaattaggccagccttgctaagaggacttgccatctaagttgaagaatgcagcgaaattactatcacaaaactgggtggaaaattgtcacaaaagtcagccgctatttcatacactaaaaaaaaaaaaaaaaagaaagcatgtataaatgcttttgctcatatacacacatctatcattcctattctttgtgaatatcagttaagaaaggacatataaaataaatatgttacaacccagtaagtagtgggaaaaccttaaggaaggtttcaaggaacatgccttgaaataacagaaggctattgtgttatcaaagactgtgcagtaccggaggggttattgcttgtatccctacattttgctttcacgtgcacaaggtaaccctatcatgtaattactccatccagcttttttcttttctttcctgtgttttttgcttctctaccattctcagggctccctctcagaaaacaagaacactggagtctgggagtctgcagcttcctgttgcatggctggctgtggaggtcctgcagatggtatctgttcagagccacttgggcacgaccaagatggcaggtacattcggggcaaaaatagcatttataatcccaattaagcagaaaatagaggactcagagtgatgtccaatatctgaggagtgatatagtgtgccttgggctttcctgtacactaatgctgtttctcctgctctttcataatgtcacttttcaagggaaaagaatccaagtctctttccatttctattttagcccacaggggcaatctcactagggaaaggatccattttttgcttttggattttcttcctctggattctacacacgattccaattccaactagattagagaaataaacaaccggtggagaagaaaatcgctcagatagcagacaagggccagaactgcctgccactagcagttggaggcaagccaaaatatttgataagaggtagcttcctgagttagggatccctgagggtggaggctgacaaagatgaagggattagagagaaggggagggaaaaggagggaagaggaggagatgagggggcaggagagaaaagggtaagaaaagctagaaaaacagtcaaaaaacccaatcagagtgctgagccagcttacagtcctgccttgcctaccccctatccccacccatgtggactttacactaggttgcataattacaccagcaaagtgcagcctctgccactggttaaaagggaaagcgtgccaggctccagcctatgggaccgttgttctgctgccacctggaaatcctcccagagctcaaagcctgctgctctgggcaaagctgacaaggaaggacagattcagcagccaaccaaggagcataccttcatttgatttccttaaggcaaaagcactggctaaacaaagggagactatctgggagaaggtgttttcaccctttcaagctggggtgctttcaccaccgggaagtgccacgctgctttccacgctggaacaaggtactgtggtttcaaagttcaaggctctgtttcagggatgggaaggaaaaaaaaatcagtgaaagaaggtgttctggtctctcaggcagaaccatttgttatttgattccagagctcatgtaatttttaaataccacactatgcattttcattactaaatgcattcattttcatcctcaagaaaagtgtatgcccccttccgcctgctttacataatatggcttgagcgcttgtaaaaatggatgggctgtagctctgagttctgccattgtgctattgactggagctcctggttactatcaccagatctatgggtggatcagccattcttctgcagcagggagtggaccgactcaaagcacttagcaccatttaaacttttgtccatctctgtttttatgcacacaaagagtttcctggaaacatggctatcctccaaggatttcagagagtagaattcttccagaactgcagtgtcccaatcacttggaacctcatgagaaagcagacttaaactcagaccctagaacctcgaacttagtatgttccaaaagctttggctctgccatttaccaactgtgtaatttggggaacattgattcatcaccctaaagcttcattttcttcatctataaaatgagatacatattagctatcttgtcttgcataacaaattaccccaaaactcagtagcttaaaagaacgtttatcgtctcagtttctgtgggtcaactctctggcattgggtctcttataagaccacagtcatctcaagctcagttgggacagatctgcttcctgcctcactcacctcgttattgttggcaggactcacttcctaaggccttggttccccaggagctgttggccagaagcctccctcggtgccctgcctcatgggcctcttcgttgagcatctcacaacgtggcagcttacttcatcagtgcaagcaagcaagagcaagagagaggactcaccagagacagtaatagcaaaacagaaggcacagtctttcgtaatccaatcacagatgtgacatcccatcactgttgccacatcctgtgagttagaagtaagtcattaggtccagcccacactcaaggagattacacaaggatgtaaagaccagcaagaggatcattgggagctattttagaagcagcctactctaagataataataacatctagggtttgtttaaaatttaaattagagactgcatggtggcagctacttgggaggctgaggtgggaggctcacttgaggccaggggtttgaggccagcttgggcaacatggtgagactcctccatctcttaaaaaaaaaaaacaaatatatgtgtatatttttaaatattcaaaaatcaaattagagaatatgttcaattcgggccagcatatgttatgtaatatataactgttatatataataactattattaccattaatattattattgactatataatggctggttttctcccctagctcctagaaggaacccttttatgaggagtaaatgaaataatatacataattcaggacctgacatgtagtaaatgctcaataatcattagttattgttaacattattaatagccgggcacggtagctcacgcctgtaatcccagcactttgggaggccaaggcgggcggatcacaaggtcaggagatcgagaccatcctagctaacacggtgaaaccccatctctacaaatacaaaaaaattaattgggcatggtggcggacacctgttgtcccagctactcagaaggctgaagcaggagaatggcatgaactcaggaggcggagcttgcagtgagcagagatcacgccactgcactccagtctgggcaacagagcgagactccatctcaaaaaaaaaaccaacattattaataaacatgtgatatttgatattctctccaagctactggaaggaaatactatgaactctcattacttttccagggtggccttatttccatatgttttgttcagtttttccattagcaccctatactcaccagagcacaattctagatttggggttcataaaatatgaccaccaaatccataacacagtctaatttcctgcctgccctataccaagaagggtatgcacaaaaccagcaaaatgggctaattatggcagcacctcctatatgcacaaaagtctgagcctggccccaaccagaatccagacagaagggattgtgcctgggagaatgaacagagacttcgctatgtgacctttgtcccttttaaaatatggtcatcattgtgcagtctactcagtcaatcctcaactaagaatgagagaaagagggacctacacaggccctacagatgggataagggtgtccaagaagacattttcacacctgggttggaagtaataagaacccataaaaataaagagcaattttgcaattagaaagttggaagaagagagtccagtttgcaacatgaaagaaagatcataagaggctggagtcaccctttagggctgggttgaagctgtcttccttataaaggtggaggatattgagggttggcctgtggccaggaaaaatgaggaactataatcaagaaaaccccattatttttgctttgagtcatttctcagggctcacccataattattacataagaaagacagaaaaaacaaaaacctcctaaagtgtaaatgatccttaaactaaaaacaccgtagaaatacaaagatccaggccgggtgcggtggctcatgcctgtaatcccagctacttgggaggctgaggcaggagaatcacttaaacccgagaggcggaggttgcggtgagccgagatagcaccattgcactccagcctgggcaacaagaaagaagaaactctgtctcaaaaaaaaaaaaaaaaaagaaaaaagaaaagaaaagaaaagaaaaagaaaagaaagaaatacaaagatccaagtttttgcaacttatctgtctctctctctctctgtctctgtttcttcttctcccacccatatttgcacatgttctttcatttcttttccgcacagaagaaaactacccttacaaggaaatgccttaggatcctccaggctggaattgttttcagatcaggaatcatcttctctagcagtctccactgcagctctacaggattagagctcagtattcacagataatgacagtttacacctctccctctaaatcaagtcacctgtgcagctgtgatttaaagagttcggatgattttctgagctgcactagccctggccctttcctctcccgaaatgttcccaaacattaccagatttgtacacagaaaggctcaaagcagaagttgctgggaaagttctgtaaacatgaaggggagatgtacaccaatatcaagttcctcttcctgtggctctggttttctctccttcctattctctattctgtgtttcctctgtgtctgggacagaggagacttgtatgtttccatacctgttaatagccagagaaaactttgttcggtcccttggcaggttagcggattttagaagggaaagacagggtaaagagatgaggactcgcccccaggaagtctgactatacaataggaatggtgtatttatttattcagccctttcctacactgcagtcatttcatttcaccctcaggatgtgtatttagtggtaagctttctttcttttcctgttagtttcctgcaaaaggacatcagtgtcttcctcattggagcagctgataagaaggatgttgttgctcaaatagagacagaaaaacatatttcctatcacagacccaggccatcccaagggcatggagaattagaccaggttgtggaaataatagaagaacctgattttcatgcctatttccctggtgccatcttcctccctgaaatactctgcaataattacaccttccacttaagtaggatttcacacttttccaaagtagcatcacgttgtacggaagtagagttggctgcactgtagctggcatagcctattagttactttggagggtttatatgaagaggcaactttgggtttaactttaagttttggggaactcatacaaatagcataggtttaccctaagttggattccatttgctagctcctgcctctcctacagatctcatcttcaaagttactattataggggaggcttcctgttatccctctcccagccacattgagttgggtgcccctcttatacacactgcatttccactttggatacacatatcccgtgggtaaacttgctcagtgcctagccatccagcaacatgtcggcactgtaataccagggacaacaaccttcctgctcatggctgcctagcatagggcctggcccacagtagttcactaaatatttagtgaatgaatgagtgagtcaggaattgtctctaggagtagccttgccacctgacacaatcacttattttggggtagtgctctgggagttataaaaaaggcctgtgctaattatcacataatgatcaccggtggttatagtatttagtaggcaaaagcacagtggtggagtatgactaaataaaggtctcctccaggtgggggctatccccgcactctgaatttggaaccccactgcccatctctcttggactcctgtggacagggtcattcctttgggaaattcttttcggagttgccaacactggggaacagggagaattaagctccatttccccaaactcaatgaagtctttctgatatgaaaattaaattaaagaacaaggccagtggtggccctctgttgctttcctttcagcctctgagacagatttccccatcaagggtctgcgctgagtcatcccgcctccagcggaaacaagtcagcagcaccctgaggatgggtgatggaggtaaagactcatcctgctaatctcctcctcccgcggaggccaaggttcatggtcttggccccctccctgggaacaaaaaggcaacccaagagaaaagactcttccttcccactcctctctctcttacaagctcatggtctgtggctcctctttcttctgccaatggaagttgaggatagagagagaggaggaggaagaagaaaccaaagggcacaggactgtactttgctggctggggggaggtgggacacatgggtggggggtatgaattgggatgaaggatgacaagacatgaagaatccttggaggttctccaacagttctcacatacagaacagctaaggcacagcccagttgcggagacaccagggaacccagaaatgtaaatagtaggaggtgatgacagcaaagaagcaggcagatctgatacacaggcccctacacagagctacgccctgtgggagaaccacaaactgcctaagactgggtagcaaagagagagagagtgggcgttcagtgtgagaccttgaatcagaggcccacactctatatctagctcagtctccaatttgtggggaggaccggggtgaaagatgaatgtcagagatgtggcttcatcagctgcctatgggatgggcacatgtttaggagatactttgaaatctctagatgaaaggaaatgccagaaaaagctatcattactttgagggctgatcatagagcagccggagcatctttgagctcctatattggaatcagagtctacagtattttcatcttgggcggaccaattcctgaagaccagttttttaatagcatcaattgagaacagggtcaattgtgaggtcccttaggaatacaaccagaaatctcatcactggagtatagaaatttccaaccaggctccagccagttatctatgcagactgattctagccaggcctaacttgcctagggtgatgatctacaggctatgacctgatgacacttctccctttctctcctctctttctctctttcacgtgtgcataaggcaacttagaaacattaattcaccaaagaatacttggagattcccaaatgatcaccccaattgtggctcttcatctccaaacacttagcctttttttttttttttaaaggaatgtgatgtgcttaaaccagatcttttttctttctatttggcaggtacataggcacatgaccctagtattttccttctctatttattcccttctatactttaccacaaatacttccacttgactccctcttctggtctctgttctatgaaccatctagattatcattccaaatgaatacatttgtgtttgagcccttaaatgcaagaatatttcccttcctggtctctccaaagctaacaggctaactagactcagaacaggactttaatctaagctggcaataagtgcttacctgtcctgaatgacctaagctgcaatcatcctgggtcacaatcatcagaggaacagatattatttttctcctattgcacgaagtggacaaaggttgtctagatggtgcagaatggatctcgataaagccagagctccttgtgaaataagaaaaatctcaagaatgggcatgtgactgctaagcaagctctgtgggagagctcaacctataatattacaagtggcatgcgtaagatcaacatgaactcatctctcaaatccccaaatcttaggtttcaatgtctcttacaaagttccaggagagttaagcttaggaccaatataaaggaagactactccaaactgtaggtagtaaatgcatggcactcattacccagggagggaatacaatcagaatacagaaaaaaaatcagggcaacatttatgaattgcagagccatatatgagtaaaactggatggatcttgaactactcattttcaaccctagtcctatgtgaaagtctcatgtctctctcctaggtcctagtattccaactcagtaggttggagtggggtctgtatatagttgcaaagctcccccaggtgattctgatttataaccaggtttgaggaccactacttgaataacttgaataacctttaacctgctggataggtctgacccagcctggtcatccttacggtcctaattgtcaaactgcttggttgatgaatgacaactcaaacagatacagctgtatacctgcaacataagaacaaactccagagcagtcattagaccctgaatctacagatcaaatcaagcagtataataatgctctggtccctggctcatttagagtcttctccaagatctctaagtctttcccaccttagggatgaatcagcggaggcacttaaaacaaggtactacttttggaaggaaatattcagatttgcttataagaataagatgcagacttcttttttcttttcttctcttttttttttttttttgagatggaatctctctttgttccccaggctggagtgcaatggcatgatctcggctcactgcagtctccacctcctgggttcaagcgattttcctgcctcagcctcctgagtagctgagattacaggcaggcaccaccacgcccagctaatttttgtacttttagcagaaatggggtttccccatattgaccaggctggtctcgaactcctgacctcaagtgatccacccacctcaggctcccatattgctgggattataggcatgagccgccgcgcctaggcagatgcaggcttctttacatatttctgtcacggctctttttgcacaatgtttaacacagtactaggaattcgtttattcagtaaacatttattgattaaaaattagttacatacccaatgccaatagtttgttgctgaggatataaataattaaataaggcagtgataaaacagaccagatgtgatctctagcttcttagttacctaataagctctcaaaaatattcttttatcatagtggctggatacagtgtaaaactctacctaagggtcatcctaccctcttaggaacacaacatttaagttctttcgaagaccgagctaccctggggccaagaacaactataaaaaaagtgcctaccttttcttctcaaatgtacctacaagtgaaggttaaaaatgaacttctggctgggcacgttggctcacgccagtaatcccagcactttgggaggccaaggcaggcagatcctgaggtcaggagttcaagaccggcctgagcaacatggaggaaacccccgtctctactaaaaatacaaaattagccgggcgtgctggtgcatgcctgtaatcctagctactcaggaggctgaggcaggagaatcgcttgaacccaggaggcagaggttgcagtgagccaagattgcgccattgcactccagcctgggcaacaagatcgaaactctgtctcaagaaaaaaaaaaaaagaacatctggagaatgagaactatgctatattcatctttgaatttccagtaccaggtacagtaccttgcacatagtaagtgttcagtgttttaaattttttttttttttttttggagacagagtcccactctgtcacaggctggagtgcagtggcgcgatctcagctcactgcaacttctgcctcccaggttcaagcaattctcttgcctcagcctcccgagtagctggggctacaggcatctgccaccacacccggctaattttttgtattttagtagagatggggtttcaccatgttgcccaggctggtctcaaacttctgatctcaggcaatccacctgcctcggcctcccaaagtgctaggattacaggcgtgagccaccgcgcctggcccagtgtttttaaattttaattaattaattaattttgagacagggtctggctctgtcacccacgctggagtgcagtggccccatctcggctcactgtaacctctgcctcctgagctcaagtgatcctcccacctcagcctctgagtagctgggactgcaggcatgtgccatcatgcctggctaatttttgtatttttttttttttttggtagagatggagtctcactatgttgcctaggctggtcttgatcctcccacctcggcctcccaaagtgaagtaattgcaggcatgagccaccgcacccagcctgttcagtgtttttgaatgagtgaatgaatgaatgaagctggaatcccagttctgccactaactgtgtatctttgtacaagtcacagattatttgtaacccttttttcatgactgggataacaactaccttgcttatttgttgttatgtgactggaggtcatgtgttctaagaatcactggcagctgggcatggtggcctgtaatcccaacattttgggaggctgagatgggaggatcacttgagcccacaagtttgagaccagcctgggaaacagagggagacctcatctccacaaaaaaattaaaaactagctgggtgcggtgagcgcgtgcctatagtcccagctactgggaaggctgaggaaagaggatcatttttgagcccaggaagtcaagcctacagtgagccatgattgcaccactgcactccaacctgggcgacagagtgagaccctgtctcaaaaaaaaaagaaagaaaattggcactctgcctggcattcagcaggtgctcaacaaatggttgtggtgatgctgtatggttgttactctgagaacggagaagcagaagcttccaagaaccaacttgtatggtcaaagtgacatctagtggtaaaattttagaacacacaccaaaagcacagtcaattgctggtttgaaatttaaattgaggaatgactaggaactaacagggcacctgatttacataagtacagtaacattatttaattctcaccagtgatttttttttttttttgaaacggagtctcactctatcgtccaggctggagtacagtggcgcgatcttggctcactgcaacctccgcctcccaggttcaagcaattctcctgcctcagcctcccatgtagctgggactacagatgctggccaccacgcacggctaatttttgtatttttagtagagatgggggtttcaccatgttgatcaggctggtctcgaactcccgaccttaggtgatcctcctgcctcagcctcccaaagttctaggattacaggcgtgagcgaccgcacctggcttcacgagtgattttcaatcctggatgcagattagaatgacgtgtgaagctttaaaaatctactggtgtctggatctcacccttggagacaccaatttaacttgcaggaggtgtgactcaggctgtcacatttttaaactgcgattttaacatgcagcctggttgggaaccacatgcaagagacccatgagatagtcttcttctcgttttacaaatgatgaaagtaaaagtcagaaggataaagtaattttcacaaagtcacacatttattattagcagtaggttatttgaacttgcatctaccattttcccacaataccacgttgctttgcagaggcttttggaagtctgatgtgctccacttagcttctgtctaggggagtctcaaactcagaagcgttaggaaattgcatggtgctgtgagctgaagccctccaaacaacagtttggtgttgatgggatagtgtggtctaatgaaggcactaactgcctgatcctctctctggattctttttttttaagacaaggtcttgctttgttgcctaggctggaatgccgtggcatgatcacagctcactacagccttgaactcctgggctcagctgggaccagaggtgcatgccaccatgcccagctatctttgtattttttgtagagatggggttttgccatgttgctcaggctggtatttttatgttttgtagagacgggggtctccctatgttgctatgaacattcatgtcaatttcaattttttaaaaattatttcaaaagaaactcattgtaattgtttgtgttaaaaaatgataacttgcccaggtgcagtggctcatgcctgtaatctcagcactttgggaggccaaggcgagtggatcacttgaggtcaggagtttgagaccagcctgaccaacatggcaaaaccccgtctacactaaaaatacaaaaattagctgggcatggtggtgggtacctgtaatcccagctactcaggaggctaaggcaggagaatggcttgaacctgggaggtggaggttgcagtgagccaagactgtgccactgtactccagcctgggcgacacaagactctgtctcaaaaacaaacaaacaaaaaccttaagcatacacattaaaaatctaccaaaactttttaaaattgagttttggcacttcatttttaaaaatataactggggtctcaaaaaggagtaacgaggccgggcgcgatggctcacgcctataatcccagcaccatgggaggccgaggccggcagatcatgaggtcaggagattgacaccatcctggctaacacgttgaaaccccgtctctactacaaaaatacaaaaaattagccgagcttggtggcgggcccctgtagtcccagctactcgggaggctgaggcaggagaatggcgtgaacccgggaggcggagtttgcagtgagccgagatcgtgccactgcactccagcctgggcaacaaagactccgtctcaaaaaaaaaaaaaaaaaaaaaaaagagtaaccagcttgctcttgacctctgaaaggctctgttgctgcctccaacaagaaaagcccattttatccaattagacaacaaatccccaaagtcagaaaaaccacgtgatatttgctggcatatccatgatgactactaattatgtatttggtaaatgtttgctgacaatatagcccatcaagaaatgatgggaggccgggcgaggtggctcacgcctgtaatcccagcactttgggaggccgaggcgggcggatcacgaggtcaggagatcgagaccatcctggctaacacagtgaaaccccgtctctgctaaaaacacaaaaaaattagctgagcgcggtggcaggcgcctgtagtcccagctattcgggaggctcaggcaggagaatggcgtgaacccgggaggcggagcttgcagtgagccgacatcgcgccactgcactccagcctgggcgacagagccagactccggctcaaaaaaaaaaaaaaaaaaaaaagatgggaaggctgggtgcgggtggctcatgcctgtaatcccagcactttgggaggctgaggcaggtggatcacttgaggccaggagtttgagaccagcttggctaacatggtgaaaccctgtctttactaaaaaaatattaatattagccgggtgtggtggctcacacaggtaatcccagctactcaggaggctgaggcgcgagaatcacttgaaaaccagaggtggaggttgtagtgagccaaggtcataacactgcactccagtctggatgaaagagcgagaaactctgtcccttaaaaaaaaagaaaacaaagaaatgatgggacagggtgagggtaggggagaggaaattctaacacaggtgatttccttctgacccacaacccccactttgctgttggtctggctgacgtggttcacaagggggatggtaacttagatggaacgtgtaaaccaatggaaacatgaaccttgattgaaaaatgaaaaatttctctagatcctgactaaggcaaggtcagcatgtttctcccacatgctggtccaaacagaagctttcttttacggcaggatagggatcagtcccttgtctaatcaaccagtggagttaatgagtatggcagaaggaagggagaggaaagatgacaaaaggagcaatgaaaaggaaacacctgacacatttatctttgtgagaagtgagaatcacctgtaaatgcctcagccaggaaggacaggtagggccctttataaaaggatttgtggaacttctggagtattttgtcattataacattttgttaatagattaacaaggctgggcgcagtagctcacacctataatcctagcactttgggaggccaaggcaggcggattcacttgaggtcaggagttcgaaaccagcttggccatcatggtgaaaccccgtctctactaaaattacaaaaaattagctgggcatgtggtatgcgcctgtaatcccagctactcaggaggctggggcggagaatctcttgaacctgagaggcggaggttgcagtgagccgagatcatgccaccccgactccagcctggacaacagagcgagactccatctcaaaaaaaaaaaaaaaaaaaagattaacaaaaacatggctgggcacagtggctcaagcctgtaatcccagcactttaggagggcagatcatttgagcccaggagtttgggactggcctaggcagcatagcgagaccccatctctacaaaaaatataaaaattagccaggcgttgtggtgcatgcctgtggtcccagctactgaggaggctgaggtgggagagtcacttgagcccagaaggttgaggttgcagtgagccaagatcttaccaccacacttcagcatgggcaacagagtgagaccccgtctcaaaaacaacaacaacaacaacaacaaacacaaaacacaaagaaacaaaaccgtgatagtaaggagagcagatgcctgcttttctgttgtgaagaaacttgggaaccactgtggaaacaggagaggggaaaggagctgtcatggacccttgctgagctccttccttcccccagccttttctcccatccctccccttacctggaaggtcctctctcctcctctctgcctaaatcttgtgccatctcagatccaacacaaattcccatgtctccatgacgactcctgccccccttccctgaactcctacagcacatctgctgtataccacacaattctcactaaattaagcatattgtctttgaaaggttcttgtgtgtctgtcttctaaaaccccttgtaaactcctcgaggacaagggccatttcttctgctgctgctccgtctcccacagtgctgatggcctaatagaccctctgtatggtcttgctggctgactgactgaagggttcagttaggctctcttgctcctgccagcaaagcaaagagtgcacaataaagtcctttcactatgaaatgacaaattcaaagatagaggggctgagaaagtgctcatacagaattattcattgtcttgaatgtctcatagtagccagatcccagaatcctcaggttagatgcggaagtaactttgatccatgtgatagtgctttttagattagtatttcacttaaagggaaagtgtaaagtaatacacattccatgggttacatgagtcaaggaaagggaagagtttctgttacgaagttagctcatatccccaaagacccccccaccaccgtgtttcatagcagtcaggaatttatagaagaaaatattgcgtgcgctctctcactctctctctctctctctccatatatatatatatatatatatatatatatatatatatatatatattttttttttttttttttttttttttttagatggtggagccttactctgtcgctcaggctggagtgcagtggcgagatctcggctcaatgcaacatccgcctcccaggttcaaatgattctcctgcctcagtctccggagtagctgggattacaggtgcctgccaccatgccccgctaatttttgtatttttagtagagacggggtttcactatgttggccaggctggtctcgaaatcctgacctcaggtgatctgcctgcctcggcctcccaaagtgctgggattacaggcatgagcctccatgcccggccttgctttttatatttttgacaataacagagccacgggaagaaaggatgtgattaggggaagaaaaaaggggagaggttcatgttgtctttattttcattaatgaatgtctcaaacattttagggtataaatagcaatcagtatttaggaaaggaagctggattcacactacttggaaatctgggtctttactcatccatggcaatttttgggtatcatgtgctcttacagaatctcatcttatgatatagattcagtttacagctattctatgatgcttgagtatttcaaatattaagtacattgaggctcatgagaattgctaatctgccgtgtgaaactgcagagttgtttcccaagggtagagatgcattcacatccacccacatagtacaaagggggaaatgattacgctggcctggattttttgtaatagtcccgtgacatggcttccacattgctctgtgggctgtggttaaagaacctaatctagaacaagacaagacttgtagatttaaaaagtcacctaagctgtttctttcctagacaaatgggattctagtttgggttttattttattttattattttttgagacagtctcattctgtcatccaggctggaatgctgtggcgcaatctcggctcactgcaaactctgccccctgggttcaagctattctcctgcctcagcccacctagtagctgggattacaggtgtgtgccaccacactcagctaatttttttgtatttttagtagagacgaggtttcaccatgttagccaggatggtttcaaactcctggcctcatgtgattcacccaccttggcctctcaaagtgctgggattataggcataagccacagtgcccagccctaatttgagtttcagagggcaatttgtaccgtttggaaaagatgctggatccttcaatattactgctttagaaagatttggaactctgacccatatttagtacatgacctttctggggcgtggaaaaatatgctctgtcatctaatgtgatgtcaattttctttaaccttccatgtaaatagtgcgcattaagacatgaggtctactgttaaataatttctctttataaacatagtgacaacaagattgtacagtatcaattaaaaagacccaatgtgaccaggtccactgcttcctgcatcttgaagtaagacaagtgttcagcttagagatgagcacctttctttccagagggagaagacatgatgggagaaaaaaatgttctctctgagaatttacccagataaagagctgggtagtcggatctaaatggtcccacagcaatccttttctcgggggaggtgcgtagatctttgacaagtgatgaacgaactttgcttcgtgtggttaggcctgggactgaactttgtaaccagggatttggtgcgcggggcttcacaggctgcagagaaacatgaaaacatgagtgcatatgccaaacgtgtctcatgtgagcggcagagcccaagtgaaggcctctttggctatagggtgtctcctttttttttttctttttgagacggagtcccactctgtcgcccaggctggagttcagtggcgcaatctcggcttactgcaatctccgactcccgggttcaagtgattctcttgcctcagcctctgaagcagctgggattacaggcgcccgccaccacgcccagctaatttttttgtttgtttgtttgttttttttgagacggagtctcacactctctcccaggctggagtgcagtggcgccatctcggctcactgccagctccgcctcccgggttcacgccattctcctgcctcagcctcccgagtagctgggactacaggcgcccaccaccacgcccagctaattttttgtatttttagtagagacgaggtttcaccgtgttagccaggagggtctcaatctcctgaccttgtgaccagcccgcctcggcctcccaaagtgctgggattacggtgtcagccactgcgcccggcgtttttttttctttctttctttctttcttttttttttttttttgagacggagtttcgctcttgttgcccaggctggggtgcaatggtgcgatctcggctcaccgcaacctctgcccccagagttcaagggattctcctgcctcagcctcccaagtagctgggattacaggcatgcgccaccacaccctactaattttgtatttttagtagagacagcgtttctccatgttggccaggctggtctcgaactcaggtgatccgccggcctcggcctcccaaagtgctgggattacaggcatgagcctccgctcccggccacgcccagctaatttttttgtatttttagtagagacagggtttcaccatgttggccaggctggtcttgaactcctgacctcatgatctgcctgcctcagcctcccaaagtgctgagattacaggcgtgagccaccatgcccagagattattctttaattaatctcaaaagcctaacaccagggtagtctctctcagcctactctggcttgaaaagctgcccattaaaaaataaaaataaaagcctaacaccagagttcgatatatgttcactcacacatttgtagaaggaacacaatatctcttataatattctttacttcactaataagttataatttcagctatacattatatggcgttattactagttaagtaataaaaccaatgtattatttatcttgtttttcatttcttaaaaaatgaataattggctgggcacggtggctcacacctgtgatcccagcactttgggaggccaaggcaggcagctcacttgaggtcgggagttcaagaccagcctggccaacatggtgaaaccccatctctactaaaaatacaaaaattagccaggcatggcgcagatgcctgtaatctcagctactcgggaggctgaggcagaagaatcgcttgaaccaggaggcagaggttgcagtgagccaagattgcgccactgtactctagcctgggcgacagagagagactttgtctcaaaataaaaaaagattaatcaattataatggaccatattattttaattttaattttcaagatttattcttatatttgttatatttatttttaatattttattatgttttttgaatattgtatgtgaaataaaaaatgaagtcatgatacaaagtaagtctgacctgtacatgaatgtttgtagaagctttattataatcacccaaaactagaagcaaccaagatgtctttcaagaagtgaatgaacaaactggtgcacctacacaatggaagagtattcagaggtaaaaagaaacgatgcctggcgcggtggctcatacttgtaatctcagcactttgggaggccaaggcaggcggatcacaaggtcaggagttcgagaccagcctgactaacatggtgaaaccctgtctcttgtaaaaatacaaaaattacctgggcgtggtggcatgtgcctgtatttccactacttaggaggctgaggcagaagaatcgattgaacccgggggtcagaggttgcagtgagccgagaacacaccactgcactccagcctgggcagcagagcaagactccatctcaaaaaaaaaagaaagaaagaaagaaagaaatgagctgtgaagccagaaaaagacatgcattattttaattattttagtagagacagaactagtagagttaattattttagtagagacatgaacctcttcaaatgtgtattgctgccaggaggttggctgacgcctgtaatcccagcaatttgggaggccgaggcaggcagatcacttgaggtcaggagtttgagaccagcttggccaacatggtgaaaccccatctttactaaaaatacaaaaattagcggggggtggcggtgcacgcctgtaatcccagctacttgggaggctgaggcacgagaatcacttgaacccgggagtgagatattgcagtgaggtgagatggtgccactgcacttcaacctgggcaacaaagtgagactgtgtctcaaagaaaaaaaaagatatgtattgctaggtgaaagaaggcagccggaaaaggcaacatactgtataattccaattatatgacattgtgtaaaagacaaagctatagagatagtaaaaaaaggccgggcatggtggctcatgcctgtaatcccaagcactttgggaggccgacgcgggcggatcacgaggtcaggagatcgagaccatcctggctaacaaggtgaaaccccgtctctactaaaaatacaaaaaaaaaattagccgggcatggtggcgggcacctgtagtcccagctactcgggaggctgaggcaggagaatggcgtgaacctgggaggcggagcttgcagtgagccaagatcgtgccactgcactccagcctgggtgacagagcgagactccatctcaaaaaaaaataaaaaaataaaaacatcagtagttgtccagctactcgggaggctgaggtgggaggatcacttgagcaggggcagttgaggctgcagtgagccatgatcataccactgcaactccagcttaggcaacaggaggagaccctgtctcaaaataaaaaacaaaaacaaaacaaaaaaaggagaggaaaaaagaaaaatcagtggttgacaggtatttgtggggaggaaaggagggttgaataagtgaagcacaggccgggcacactggctcacgcctgtaatcccagcactttaggaggcccacgcaggcagatgacttgaggccaagagtttgagaccagcctggccaacatggtgaaacccagtctctactaaaaatacaaaaattaggccgggcacagtggctcacacctgtaaccccagcactttggaagcctgaggcgggcagatcacctgaggtcagaagttcaagaccagcctggccaatgtggtgaaactctgtctctactaaaaattcaaaaattaaccaggcatggtggcaggcgattgtaatcctagctactcaggaggctgaggcaggagaattacttgaacccagaaggcggaggctgcaatgggccgagactgcgccactgcactccagtctgggcgacacagccagacttcgagactccatctcaaacaaaaaaagggaagcacaggagactttttaaggtggtgaaactattctgaatattctgtataatatatgatggttacatgacattattcatttgttaaaacctgtagaactttacagcaagaagagtgaaccttattttttgagacagagtttcactcttgtcacccaggctggagtgcaatggtgcaatctcggctcaccataacctccgccttccaaattcaagcttcttttaaatgcctcagccacccaagtagctgagattacaggcacacaccaccatgcccagttagtttttgtatttttagtagagatgggggtttcaccatgttggccaggctggtctggaactcctggccctcaggtgatccacccatctcagcctcccaaagtgctgggattgcaggcatgaggcaccccacccagccagagtaaacgttaatgtatgcaaattaaaacaaaaacatttaggaagtaaggggatctaggaaggaatacggactgcatgtagcaagagaaccaaatgtatagagcaacttcagtgaagggagtaggaaaaacttcggaaatgtgtggaatctataagactaaatacaacaggaattgcacatagcactgtactctagttaataaaattgtttcccaggggagtgtgggttaatatttctgatttatgtatggaaaattggaacatgaagtatactaataataattgtaatgattacctgaaagaaatatagacagtcttctagtcatggagaataaattttaaaaccttcattttttacatcaggtgttttttatttgtttgtttgttttttagagacctggtcttactatgttgccccagctgccagagtgcaggagctagtacctattcacaggcacgatcatagctcactataaacttgaactcctgggctcaagtgatcctcctgtctctggcctcacatgtagctaaaactacgtgtaccatcatgccccaaccctcaatttaaatacagatttttgttgcagatgtgatgatgaaaaataaatactttcaagcacaattgtatattaggataaaattctgtgtggaagttacttcataaaggaaatgtgagcgtttttttttaagatgtaattttaattttaaagaagagcttacatattttatttttaaaatggatgatggtagttatcaaactgttatggcatttagattcaaatggatgcatttaaattcagttttgaacttaaaatatcaatatgtaaagctggaatacttacatgtttgaaattaaactctgcttctatttaaaatgaaaacattttagatgtcaattttttttttttgagacggagtctcatctctgtcacccaggctgtagtacagtggctcaatctcaggctcactgcaacctccgcctctcaggttcaagcgattatcctgtctcagcctcccgagtagctgggattacaggcatgcaccaccatacctggctaatttttctttattttcagtagagacggggttttaccatgttggccaggctggtctcaaactcccgacctcaggtgatccacttgcctctgcctcccaaagtgctgggattgcaggcgtgagccatcatgcctggcctcattttagatgtcaatttaagaaggtaaagaggtgacatcatttttcaaaattattttataggttatatgagcaagcaaaagagttggaaattcaacatcctagatagcatctgttacgacgtatagcaagactcagccaatttgttctgtaaaaggccagatagtagatatttcaggcttttggggccagatggcctattcaaactgtggttttttgtttgtttgtttgtttgtcattgagagggagtcttgccctgttgcccaggctggagtgcagtggcgcgatcctggctcactgcaacctctgtctcccgcattcaagcaattctggtgcctcagccacctgagtagctgggattataggcacatgccaccacacccggctaatttttgtattttttagtagagacggggtttcactatgttggccaggctggtctcgaactcctggccccaagtgatcctcccgcctcagcctcccaaagtgctgggattacaggcatgagccaccacacccagcctaaactttatattaacatcctaaagttaaacatgaaaattcttctataacaaataatcccattgcccagagggaacttctttctgtcttcagtttggtttatatctttccagatattcaactatgcaggcagacacacacacacacacacacagacacacacacacacacacacacacacacatatatggttttaaataaattttacataatgtaggctcatgcctgtaatcccagcactttggaaggctgaggcaggtggatcacctgaggtcagcagtttgagaccagcttagccaatatggtgaaaccttgtcactactaaaaatagaaaaattggctgggcatggtggcaagcgcctgtaatcccaactacttgggaggctgaagcaggagaatcgcttgaacctgggaggtggaggatgcagtgagccgagattgcaccactgcactccagcctgggtgacagagggaaactctgtctcaaaaaagaaaaaagaataaagaaaagaaaagaaaattatatataatgtatattggctgcattttttaagcaaaaaatgggacaacatattgttctataatttgattttttaacacgttatagacatttccttgtcattcctttaaataactattgattggtagatatttgagtaatttccagttttgaaattaaaagcaacaaccatctatgtgtaaatatctttgtacacatgggtgaattttttttttttttttcgagacagggtttggctctattgcccaggctggagtgcagtggcgccatctcagctcactgcaacctctgcatcccaggctcaagccatcctcccaccttagcctccctagtagctgggaccacaggtgtacatcaccatgcctggctaatttttgtatttaaaatttttcggcttggcatggcagctcattcctgtaatcccagcactttgggaggccaaggcagttggatcacttagggcaaggagttcaagaccagcctggccaacatggcaaaactccatctcaactaaaaatacaaaaattagttgggcatcgtggcacatgcctgtaatccaagctactcaggtgaggcacaagaatcgcttgaacctggcaggtggaggttgcagtgagccaagatcacgccactgcatttcaggctaggtgacaaagcaagactctgtctcaaaaaaaaaaaaaatgctgatttttcatagcaacagcgtctcaccatgttgctcaggctggtctggaactcttgagttcaagcaatccacctgcctcagcctaccaaagtgttgggattatcggtgttagccactgcacctggccagtgaatattttttaaggatagatttctagatgtagaattactactgggtcaaagatatcaaaattttgtattgatgaattgtcatctaaaagtttttaccagggtttctcaatcctggtactattgacatttgggcccagatactccttggttatggggtttcattgtacattgtagaatgttttacagcatccctcaatgctagtagcacccccactgttggacaaccaaaaatatctctagatattgctaaatgacccctgggggtgcaaaatagccccaggttcagaaccactgcctcggacatttgctttcttttactttccttttatttctctttctcaccatctccctttcaacaactcatgctatccttccttcttaaagaaaagaacttatgaggctgggtgtggtggctcacgcccgtaattccagcactttgggagactgaggcaggtggcttgcctgagtccaggagttcaagaccagcttgaccaacatggcgaaaccccgtctctagtgaaaatacaaaaattagccgggtgtggtggcctgcgcctgtaatcccagctacttgggaggtggagacaggagaattgcttgaacccaggaggcggagattgcagtgagccgagatcgtgccattgcactccagcctgggcaacagagtgagactctgtcttgaaaaaaaaaaagaaaggaacttataatttagtatatatcacccttccttcccagtatatttacactttagatatagatgaagtgaaagtgacaatgactaattcaagaataactatctaatgatgggatgaattttgatgggagagataatttggggtactttcctgataggctttaaatcatactatgtacacttaaacatcctgttggctctattcatcttcttttctgtagaagtttctctgaataacaatgattagcatctatattcagaatgtcaagttcctggcccagcgcgatggctcacgcctgtaatcccagcactttgggaggccaaggcgggcagatcatgaggtcaggagatggagaccatcctggctaacatggtgaaaccccgtctgtactaaaaataataataataataattaaaaaaagaatgtcaatttcctttgatttttttaaaagggaattctattgattcaaaacaaaaaaaaaaagaagagaaaggtaagcaatgcttaaaaatcaagaaaaatgagatgaattagggaaagtaaagtttattgtttaaaaaatactatattttggctgggcacagtggctcgcgcctgtaatcccagcactttgggaggctgaggcaggcagatcacctgaggtcaggagtttgagaccagcctggccaacatgggaaaccccatctctactaaaaatacaaaaattagttgggcatggtagggggtgcctgtaatcccagctactcgggaggctgaggcaggagaaaattgcttgaatctgggaggcagaggttgtagtgggccaagatagcaccactgcactccagcctggatgacagagcaagactctatctcaaaacaaacaaacaaacaaagcctatatttttagcagggcatggtggctcatgcttgtaatcccagggcagtgtgctaaatgcaagacgggatagaaaaaggcataaggaagtcttttccttgaattttaggaaggaatgtgacaagaacatgaattaccagcacaatgtgttaaattcatgtgaaagagtcaaaattctcttgagatgaaggagatggtagcgcctttggagaggagatggaatgtgaaatgggctttaattagggttttgacaaaagataattgggggacaatatgcagaggaaacagcctgagaaaacatataaaggatgatataggtaagcaacagcaaacagtctagcttgtagaagtagagtttacaggggttggggatgataggctgtaacattatgtgactccagtacctagctgaggaacttggatttgtcaatggggcacctaggtagattttgagtagggtgatgacaggtttggggcctcaacttgagaaaattcatcttgtagctatctgtggtataaattggcatgggggctgataaggtttggctctgtgtccccacccaaatctcatgttgaattgtaatctccaatgttagatgagggacctggtgggaggtgattagatcatgggggcagatttcccccttgctgctctcatgatggtggttgagttctcacaagatctggttgcttttgtttgagacggagtctcgctgtgtcgcccaggctggagtgcagtagcgtgatcttgactcactgcgacctccacttcccgggttcatgcaattctcctgcctcagcctccagagtagctgggatgacaggggcgtgccactatgcccggctaattttttgtatttttagtagagatggggtttcactgtgctagccaggatggtcttgatctcctgacctcatgatccacccaccttggcctcctgaagtgctgggattacaggcatgagcttgcttccccttcaccttccaccatgattttaagtttctttaggcctccccaaccatgcttcctctacagcctgaggaactgtgagccaattaaacctcttttctttataaattactcagtctcaggtagttctttatagcaatgtgagaatggctaatacaggagcaattaatggtaaagagacagtcgggcaccgcggctcatgcctgtaatcccagcactttgggaggccgagataggtggatcacctgaggtcaggaattcgagaccagcctgaccaacatggtgaaaccctgtctctactaaaaatacaaaaattagcttcggtggtagcaggtgcctgtaatcccagctacctgggaggctgaggcaggagaatcgcttgaacctgggaggtggaggttgcagtgagccaagattgggccattgcaacacagaggttggggtaacacagcaagaccctgtctcaaaaaaataaaataaaaataaaaaataaaggtaaagagactagttgggaggctatttgtaataaaccaggatttgtctgcctcaacactacactactgacattttgcatcagacaattatttgttgtgggagggttgtccttagtattgtagaatgtttagtagtgtctctagtgtctgtttactagatgttagacaacccctagccccctatatgacattgccaaatgtccctatggagacaatatcacccccagttgataactgtgtgtgtaacagaccatgtgagaaataaaaaagggtggatgttagacatgggtaaggacaaaatctaaaagccttggcaagtgtttggataggcttgcaactgagaaagagggagtgttgaaagctcaaacagagaaaggtcctagaggccatgtactgtagtctaatatgcttatcattgcttgaaacattgtaaaccctcttggaaggcagtttggtaaaacctattaataatcacaaaaagtatcttactttttgacccagcacttttatttctgggagtttatcttaaatgattcaaatgaagacaaggaatctttatgtacaaagcaattagttgcatgacagacagtgaccacgttctcaaaaattacacccgcatgccaccacattgcctgttaaattagaagccgatttaagatcctgagtttaagagccaaagaagttgtagctaaagaaacaaaatcccagaggggcaggaagggcagatatcaagaatgcaagtagagaaattcttaacttatttttcagagagaggacaatgaatttgagaatttgtattggagaaaagagggagagaagttaggtggaggaactcctagataaggcttcaatcagtgaattcatctgcagagcagaagtttctgcggaactcaaactgcctgggggcattccttgaaaagaagaattctgcactttttggtgggaacctgccggtggaacatcctgtttagaaatgaggacatccaaggaacactgcaatgtgcagagactagaaggaaaaaacagtcaagtagccatttctcctggggagtctctagtaacttgattttgtgcttcttcttgttttttgagacaagagtctcactctgtcgcccaggctggagtgcaatggtacgatctcggctcactgcaacctccacctcccgagttcaagcaattctcctgtctcagcctcccgagtagctgggactacaggtgcaagtcaccacacctggctaatttttgtaatttttaaattattatttatttttatttttttgaggcggagtctcgctctgtcgcccaggctggagtgcagtggcgccatctcggctcactgcaagctctgcctcccgggttcacgccatcctcctgcctcagcctcccgagtagccgggactacaggcgcccagcaccacgtccggctagttttttgtatttttcttttttagtagagacggggtttcaccgtgttagccaggatggtctcgatctcctgacctcgtgatccgcccgcctcggcctcccaaagtgctgggattacaggcggagccaccgcgcccggccaatttttgtagttttagtacagacggggtttcaccatactggtcaggctggtctcgaactcctgacctcaggtgatccacacacctcggcctccgaaagtgctaggattacagtcgtgaaccaccgcgcttggccgcaacttgatttttaaattgctctctgagtgtagattccttgtttgtttggcaagggttcttgccgctgccgctacagcttgaagccaaacatttaatgaaagagagcgggaggggccgaatagaagaatgatgggcgtggccaaccccgaggtggctggaggccgcgcccccttcccagagtgcaccgcagccgctgcattcaggaaccgctttagcttcgcccccggccggccgggcggggaagactggtgtggtctggccatggatgggctccaggccagtgcagggccgttgaggcgcgggcggccgaagcgccggcgcaagccccagccacacagcgggtcggtcctggccctgcccttgaggtccaggaagatacgaaagcagctgcgaagtgttgtatcccgcatggcagcgctgaggacgcagacgctgcctagcgagaactcggaggaatcgagggtggagtcgacggccgacgacctgggggacgcgctacccggtggggcggcggtggcggcgtcccggacgcagcccggcgagagccatacggccacctggggcccgcagagctgctggaggcctcgcccgccgcgcgctccctgcagaccccgtcggcgcgcctggtgcccgcttccgcgccgcccgcgcgcctggtggaggtgcccgccgcgccggtccgggtggtggagacctcggccctgctgtgcaccgcgcaacacttagcggccgtccagtcgtccggggcccctgcgacggcgtcggggccgcaggtggataacacgggtggggagccggcctgggactccccgctgcggcgcgtcttggccgagctgaaccgcatccccagcagccggcggcgagcggcccgcctctttgagtggctcatcgcgcccatgccgccagatcacttttaccggcgcctatgggagcgcgaggcggtgctggtgcggcggcaggaccacacctactaccagggacttttctctaccgctgacctggattcgatgctgcgcaacgaggaggtgcagttcggccagcatttggacgccgctcgctacatcaacggacgacgcgagaccctgaacccacccggccgcgcgctgcccgccgccgcgtggtccctgtaccaggccggctgctccctgcgtctcctctgtccgcaggctttctctactactgtgtggcagtttttggctgtgcttcaagagcagtttggaagcatggcaggctccaacgtttacctcacgccccctaactcgcagggctttgccccccactacgacgacatcgaggccttcgtgctgcagctggaaggtaggaaactctggcgtgtataccgaccccgagtcccaaccgaggaactggctctgacatccagccccaacttcagtcaggacgacctcggtgagccggtgctgcagaccgtgctggaacctggagatttgctgtattttcctcggggcttcattcaccaagctgaatgccaggatggagtccactctctgcacctcaccttgtccacgtaccagcgcaatacctggggtgacttcttagaggccatactgcctctggcagtgcaggctgcaatggaagaaaatgtggagtttcggaggggtctgccccgagacttcatggattacatgggggcccagcattcagattctaaggatccgcgaagaaccgctttcatggagaaggtgcgggtcttggttgcccgcctgggacactttgctcctgttgatgctgtggccgaccagcgagccaaagacttcattcacgattctctgccccctgttttgactgatagggagagggcactaagtgtttacgggcttccaattcgctgggaggctggagaacctgtaaacgtgggggcccagttgacaacagaaacagaagtccatatgcttcaggatgggatagctcggctggtgggtgaggggggccatttgtttctctattacacagtggaaaactcccgtgtgtatcatctggaagaacccaagtgcttggaaatatacccccagcaagctgatgccatggaactgttgcttggttcttatccagagtttgtgagagtgggggacctgccctgtgacagtgtggaggaccagctgtccttggcaaccacgttgtatgataaggggctgctgctcactaagatgcctctagccctaaattagtttcttgttgattgctggaaacaaggcagtagtgattctccgctgccactgctaccttttttttttttttttccttaaactcacgttcttaccttgataagcatcagtgtgctcacatttacctttatcactgcttcagtgtcacaaacctcggaaggtcttctaggaagaaccatctcatctaggtacaaaaggaaaaggagaagttggaggtggaaaaaaaacccttgatccgtgatcatttcagagcaccaacttcatcaccttcaggcttcagtgtactgggtaacactgaccatgtcgttctgcttgagacagatattagattttttttggaatttggatctttcatctgagttctttttcatgggcgggtcggggtcagtatcctgtttgttattgttaaatttgtatgaaccttagaaaagttattaaagtgccaaagaatgtttccctttcctaaggctagattattatgtgggatggttcgaagaaatgcaggagcgggaggaagatagggaaaatctataatggctgaagtgaaaagcaacctggggtggttgtagcatgtaaaaggagcatgttaatcaacctcttaaggaagagactctcaggctgggtgcggtactcatgcctgtaatcctagcactttaggaggccgaggcgggtggatcacctgaggtcagcagtttgagaccagcctggccaacatggcaaaaccccatctctagtgagaatacaaaaattagccaggcatagtggtgcgtgcctgtaatcccagctactaggggggctgaggcaggaggatcacttgaacctgggaggtggaggttgcagtgagctgagatcatgccactgcattccagcctgggcaacagagcgagactccgtctcaaaaacaaaaacaaaaacaaaaaagaatcttatctgattgggaccagttcactaactttggggataatttatgctatttaattatgcaacccaattctagtagaaaaattattttctaccagcttgttcagttttaagatcatggtatgtttttgctcactgtttgcttacatccatggctggcactgctgtcataagggcagcatgtcacctagttgtgccttcatagaccttaggcaaccaacttttagcaagctggccatgaaggaaggctactgttcaagttactttccactctcatttttattctggcagttcgaagaaacttccccaaatctgacaagtgaatattctcatggttggtggaaaagtgcctgatgtaccagaaagagcactggacttggaaccagaagacctgggtttggggtggtagctggtaggcagctggctgagtgacctgaggctgatgctacgctcaggcacacagattttgtaagtatattttggtacagtttgatttctgcaccctcatcatttaggttgcgtctgggactcttaagagtctgtcaccataatggatagttttctgttatttaaggttgagaactttacaaattctttttaaaaaagttacaaaagcatagacatacactaagtaaaaatgatagttctccctccaaccccactttccagagacaagcactattttttgtttgtttgtttttttgtttgagacagggtcccactttgttgcccaggctggggtacagtggtgagatattgggttactgcagcctcaacctcctgggctcaagcaatcctcccatctcagcctccttagtagataggactaccagtgtgtgccaccacacccagataatttttatttatttatttttttgtagagatggaggggtcttgctatgttgcccagactggttttgaactcctggcctggggtgatcctcccaccatggcctcccaaagcactgagagtccaggtgtgcgccaccacgcccaaccaccaaccactaccactattaaggttaagctcataaagcttttttgagtgcttagtcaaacatacatggtagtattgttttataaagacttgtgtttttctgatatgtccttttttgacctaacttttaagtcagttcaaatagagataacttttttttaagggagaaaataaatgaataaaaacccgagaaacaaacaaacaaaaaaaaaacacaaagactgagtggatggtagccaagagggaagagagtaccctttcctgactctttcatcctctaaggcttgctactaagtcccaaaacatccagatcctggaagaggcttattaaaggaatcaaggcatggaactcacccctaggaaacctaccctgaaaagtttcttggagtaaagtctggagtgttagtggtccttgttctcctttgggtttcaagtaaacacgttttgcttcctccctcacttttcccatgaccatctccagcttgagtattttgtgtgtcagcaagtccttttggcttagtgttttaatctaaattagaacaaataatgtttgaaaaacaaaacaaaacacctgtactaggcagcaaattatcaaaaaacattaataaagtgattgtaggaggctgaggagggaggatcacttgagcccaacagttcaaggctacagtgagctgtgatcatgccactgcactccagcctgggcaacaaagtgagaccctgtctctagaaaataaagaagtaactaattgcatatgcttatcagtagtaggtggtacataagtgcctgagaacattgttctcttatgatattggttggagattttttatacctgttcgtgaaaattttacttcagctttttgggcatgatgaacctgctaagaattgcttgcttgatgtgaagttggtttcttgaattacctttttaaagtcctttcccctctattccttcatcttatctaacagctttgaaaaattagaacaatccaggccaggcatgatggctcatgcctgtaatcccagcactttgggaggctgaggcgggtggatcacttgaggccaggagttcaagaccagcctggccaacatagcaaaaccttgtctccactaaaaatacaaaaaaattagttgggtgtggtggcacatgcctataatcccagctattttggtggctgaggcacgagaatcacttgaacccaggaggtggaggttgcagtgagccaagatcacaccactgcactccagcctgggcgacagagcgagactgtccccccctcaaaaaaaaaagcaaaaattatgttaatcctttcagctagagattttctttggtgagaaaacccagattaggaattcagaaaaattaagaagaaaatctagggggccagctctagtcccttattccttctctatgcctatttgaaaaaaaggaaaaataaacaacttgggtttggggttgatggggagaaaataggaagggagggaaatagtatttctgaaacaatgagggttacttgataggactaataggatttttgttttgtttttgtctttactagtaggaccttgtaacccaatcttgcacagatgctttgcatcttcaaatgatgtggcatctgtgtctggggttttagaaagtacttctatggtgggaaaaagggtatgtacatgtttgaggaggacagggtctgaggaactcttgagagtcctgaattttctcttgagaacagagcttgcacttatttaccctgttcttgatctcctgaagcatttcttggtttccttcatttcctaagttgagtatcttcattgtctggtacatttctctgaaagataagaagggcttcttagattattctaccctgccctttaaaaaagtatgggggtagaaaatataggacttggaatcaggtaagaatcccaagttccaatcctaactgtgcagttttgctgagccttatatgcaaaaatggtataatgcttagcttacaggaataatgtgcagtttttgagacaatatatttgtgggttttttgtttactttttgtttttgcgagatggagtcttgctctgtttcccagagctggagtgcaatggcacgatctcgtctcggctcactgcaacctccacctcccaggttcaagcgattctcctgcctcagcctcctgagttgctgggactacaggcgcgtgccatcatgcccagctagtttttgtatttttagtagagatggggtttcaccatgttggccaggctggtctagaactcctgacctcaggtgatccacccgccttggcctcccaaagtgttggggctacaggtgtgagccactgcacccggccatgcccgtctaatttttgtatttttagtagagacaggtttcaccatgttggccaggctggtctagaactcctgacctcaggtgatccatctgcctcagcctcccaaagtgttgggattacagatgtgagccacctcatctggccaagacaatatatttgaaggtgccaataggtaccatttactgaacacctttatgacaggcgctaaacatgtcatctcattaattatcaccacaaccctataatgtagactatcacctgcatttgatacatgaaaaaaatgggctcacagagtttaaataccttacacgggctcacatagctattgcatgccagagctggaattcaaaccctggtctttttgactctaaaacttgttgtcccaataggcatttgataaatgttagttgaatatatgaataacttaaaacccatcctttttttttttgagacggagttttgctcttgttgcccaggctggagtgcaatggcaccatctcggctcaccgcaacctccacttcccaggttcaagtgattctcctgcctcagcctccctagtagctgggattacaggcatgtgccaccatgcctggctaattttgtatttttagtagagacagggtttctccattttggtcaggctggtctcaaactcccgacctcaggtgatcctcctgcctcagcctcccaaagtgctgggattacaggcgtgagtcatcacacccggccaaaacccatcctggtggggagaaaagatgcatgaactacataagcttgactttcaatctaatttaggccagtttttcagttacctacttgggtgagtggtgaatgtgcaggtgaaccagtgcttttactgccattaggtagcctggaaaggcagggacatattcaatgagcaaagatgtgagagttggcagtataaggtcatggtgggagccagaggtttagtgcttactttagaacagcatcgtggttctccaggagcagcacgtctaggaaggtgtccctgacccggtccccttgaagtttcagggctaggatgctacggcaagcttccagccgtacacctggtgactcttcatagtggatagcccagagcagaagatccgtcagctcgggacttacttgcccaatctgtcccaaagctgcagagattagagggcagcatgtcactgaagactgagcttactatattctagcatccagaaataaattgagttttgcaaacaataccttcccttttggatggtaatcaccattagaattttagggataggtcagaatgggacattacctccaaaggattcctagaagagggatgttccatcccatccttgcctgttaggatatttgcctattttgggatgaaatatagaacaaataacatggaagacctgcctagtcccagcagggtgatggggaaaggaggcacaattatttatctatgtcaaaaagagaagcaatgccaaagattctaaaaagaaactaggcagattaaggggcagggttttaggtctgtagcagtcttgaaactgatctgacttttgcagagcgtaatagttgagatctccaaggaaagcaagatgcatccagcactggatacctacttggaacttatccttaattctgttggcagggactgtcttgtcagccctttctttaacttaagtttgacatatacctagactcaggatctttcactaaaaattgaagaaaattatctttctcttttcagacaaggaacttctgaaaagctaagatcattacctctcctgcacttcaccccattagagagtttcaggggatcatttctacttgcataggcaaaggtatttaaggttgaagagtttggggcactacttctataatacctcgaatggcaaaggccttgattttccagtaaggatctctctgcatcaggttcaggaggcattcaagcacctgggatggaaaaggcagtgttgagtggggaggaccagagcaagaatgaaccagaaacagctgggtgcggtggtgcacccctgtaatcccagcattttgggatgccaaggtgggcggatcacttgacatcaggagtttgagaccagcctggccaacatggtgaaaccctgtctctactaaaaatacaaaaattagccgggcatggtgtcacacgcctgtaatcccagctactcggaggctgaggtaggagaattgcttggacctgggaggcggaggttgtagtgagctgagatcgtgccactgtactccagcctgggtgacagagcgagtctccatctcaaaaaagcaaaaaaacaaaacaaagcaaaagaatgaatcagaaacagggaaaccacttatctctaaaaggagctataattgaaaaatgacctatcaattctggtgacaaatgagctggagcctaaagtaccaacctatatgcatagtgagtacattagctgaattatctgctattgattttctcagtctacagatctggggccatatggcttctcttgaacacttcaaacagatttttccctaataatggaattataactccatttatgggagttgatcctaaagcccatcagcacccaggtaatgagaagctagttaactgaggtgagaacaggattcaggggtgtgctctagaatcgaagtctgggctggctgggagctaaaccaagcttgtccaacatgtggcctaggacaacttggaatgcggcccaacacaaatttgtaaactttcttaaaacatgagatttatgccaggcgcggtggctcacgcctgtaatcccagcactttgggaggccgaggcgggcggatcacgaagtcaggacatcgagaccatcctggctaacacggtgaaaccccatctttactaaaaacacaaaaaaattagccaggtgtggtggcaggtgcctgtagtcccagctacacaggaggctgaggcaggagaatggcgtgaacctgggaggcggagcttgcagtgagccgagatggcgccactgcactccagcttgggtcacagagcgagactccgtctcaaaacaaacaaacaaacaaacaaaaaaaccatgagaattatgcacggaccttttttttttttttttagctcatcaactatcgttagtgttagtgtactttatatgtggcccaagacaattcttccattgtggcccagggaagccaaaagattggatgcccctgaaacagtcctgtttgaagtggcttatacacccccttcccagttccaatctctcattctgtgtccccacagaatgttgagcatactgtgcacaaccagggaaggtaatgccctcttcaggtcaatcaggtaagatgagaatatgtttccctgactcaccatcttgtcgcggatctgcagggcaccagctgccaaacaggctgcccgccgaactgctgtgaagtcatcagagaagcagtgcaggaagcttgggagaagcttggcggtcataagcttgagctcacctatcaggtagagagcttccacacgctcctgggaatttccttgacctagcttgaccctgtaaggcacaagttgctttcctttcacctccttaaactttcagtacctaacccccaacccccactaatgccctcatgataaaatccgggttctgtaggctgtcaatcccattcagccttatgctcatgagataagttttactgggtacagagctcgattgtcttctttacttgaatccctaatacatagctgttcagtaattaggtaatgcagggctttcagttacactgaatgactgaataaaggaaaatgtcaacttgcacctcttttcacagtcaagttctcttctccattgccctcacgtgtgccatgattatgtctgcatttggcttccagcctggaatgcctatgcagtctttttgtttgtttgtttaaattatttttatttattttattatttttttgagatggagtctcgctctgttgcccaggctggagtgcagtggctggatcttggcttactgcaagcgccgcctcctgggttcacgccattctcctgcctcagcctcctgagtagttgggactataggcgcccaccaccacgcctggctaattttgtttttcttgtatttttagtagagatggggtttcactatgttagccaggatggtcttgatctcctgacctcgtgatctgcccgcctcggcctcccaaagtgctgggattacaggcatgagccaccgcgcccggccttaaattatttttagagatggggtcttgctatgttgcccaggctggtcttgaactcctgacctcaagtgattctcctgcctcagcctgagtagctgggattataggcacttacccactctgcggctcctatgcagtctctctctcttttttttttttttttttttttgagatagggtctttctctgttgcccaggctggaatgcagtggcatgatgatggctcatgacagctttggacttcctggacccaggcagtcctcttgcctcagcctcccaagtagctgggactacaggcatacaccaccacactggctaactttttattttattttattattattatttttgagacggagtctcactctgtcgcccaggctggagtacagtggcgtgatctccgctcactgcaagctccaactcccaggttcacgccattctcctgcctcagcctcccgaatagctgggactacaggcgcccgccaccacgcccttttgtatttttagtagagacagggtttcaccatgttagtcaggatggtctcgatctcctgaccttgtgatccacccgcctcggcctcccaaagtgctgggattacaggagtgagccactgcgcccggccaattttttttttttttttttttaatttttagtagaggcaaggtcttgctatgttgcccaggctggtctcgaactcctgggctcaattgatcctcctgcttcagagtctcaaagtattgggattacaggcgtgtgccactgggctgggcctcctgtgcagtcttatccaccctctgtgaaacttggccttactcctctagccacgctgagtattccatttttctgctccagcagttatggtatatgccatttgttctagtttttaatgatttggtatttttaattaggtgtttgtatattttgcatgtggtcatcagaattgcgtcatacttttgaacaccctccagcaccgaaaccattgcctcacacctactgggcactcaatgcttctttccctagccacattgttagtttgtagggactgttaattttttacagtgggacctggtccagggtccgtacagaggagctcaacaaatgctgggtggctggatcccaggcctcctaagcactttttttttttgagacggagtcttgctctgttgccaggctggagtgcagtggcgcgatctctgctcactgcaacctccgcctcccaggttcaagcgattctcctgtctcagcctcccgagtagctgggatgacaggcatgtgccaccacgcctggctaattttttgtatttttagtaaagacagggttttactgtgttagccaggatggtctcgatctcctgacctcgtgatccgcccaccccgtcttcccaaagtgttgggagccaccttgcccagcctgcctcctaaacacttctaagaatttagaagagtgtctcctcatgttgactgggtcttacctgattatgtcgtgcacctctttcccgaggctcatttgcccaagcgcctgtgcagctgctctcctcacttccttattccagtcattccacatcagctggatcaacttatgtttcatatcctataaataggtatgatcattaggtatcatcacttaatgaatgttaattttgtgcttggcgttgtgctgttttttcttctttttttactcatcactgtactaatgaggattgtcctgagtgttttttcccatcgcttactctcccaaagaatccagtggggcagatattactaccatttacagatgatagaatggaggctttgatcagcttgtccaaggttaacctggtgagtgctggaaccaggactcaaacccaactctcccaagctcatcctttaaactatgtagtatcagtgccaacataacttgtacctgggagacttaaaatttgaaagtgatacttgatgaagtgactagctcattgcagtttgcctgggactctcctggttttggtcctgaaagtcccatggcctggacaaaccagaacagttggtcactctataagtgcacttctctcagagaggaatgggcaaagattactacacgatgatgtgtaaatgtgcccacgctgttcttcctgctagaagtatctcccttctctactcctacctggtacttgatgtctttgtagtcttcctttaggatttacctcaaaagcatctccttcctatctcttttattaaaaattttaaaaaataaaataaaaacatctccttagtgaagtcttctttgccccttgtaagcacaggaaatccccacaacaccttatagctgcttctgttctagctatttgtaacatttactaacggaagacttatccctgcacccccaggggtagcatagtgcctagtgcgtcggatgtggtcagaaactgcatgcttactgaatgagtgaaaagactcatagacatactgcctttcttagctccagcaatctgccatgaagtcctcatcatctttacctcaacccctgctagctctgcatgtctttttactttcagttgtcaattctaagtgacaagtgccaaggaggtgaaggtacaaatgaattggaagttgttaaaatgatattgttaagatgcagattctgattgagctggcttaagatgagatttttgcatttcttttttttttttttttttgagacggagtttcactcttgttgcccaggctggagtgcaatggcacgatctcggctcactgcaacctccgcctcctgggttcaagtgactctcctgcctgagcctcctgagtagctgggattatgggcatgtgccaccaagcctggctaattttttttttttttttgagacggagcctcgctctgttgcccaggctggggcgcagtggtgcgatctcaactcactgcaacctccacctcctgggatcacgccattctcctgcctcagcctcccgaggagctgggactacaggtgcctgccaccacacccgcctaattttttttatttttagtagagacagggtttcaccgtgttagccaggatggtctcgatctcctgacctcgtgatccgccctccttggcctcccaaagtgctgggattacaggtgcgagccactgtgcccggccgatttttgcatttctaataatgctcctaggtgacgcctgtgctgctggtccaggactttagcagcagggtgctatagcacttgagacagaactaacccaagtccaaaaccttttcaggtgattactgtactgagtggccagattttgtgcttcccatatcaaaatgtcagggttacagagtggaggttgttcacttatcatgggaatggcaatgttctgggctattctggagatatccaaagttataaggaaaagatgaagtagcacataggaagaagggaaagctcccatttggacagctgaagatgattgggaaataatggcaaaaacgaagtgttgcctggaattccctctttagttctagctgagccccaccatcttcaccgacagttggtttgtttttttttttagatggagtctcgctctgtcgcccaggctggagtgcagtggcacgatcttggctcactgaaaccgccgcctcccaggtttaagcgattctcctgcctcagcctccaagtagctgggatgacaggtgtgtgccaccatgcccagctaattagagatggggttttgccatgatgaccaggctggtttcaacctcctggtctcaagtgatccacccgcctcagcctcccaaggtgctgggcttacaggcatgagccaccgtaccggaccccttcacagaactttaaccaataaatttaacccacactaatctctctctctctgaaaagttttaaaagggtaccttatatttattgcttgttcttgaatcatttgtgtatattagtcttattgttcctaccatagtgttaattttgtgaaagttgggacaatggtttttttgttttgtttttttttgttttgttttttgagacagagtctcgcactgtcgcccaggctggagtgcagtggtgcgatctcggctcactgcaacctctccctcccaggttcaagcaattcttgtgcctcagccttccaagtagctaggattacaggtgccagccaccacacctggctaatttttgtattttagtacagataggatttcactatgttggccaggctggtctgaaactcctgagctctgatccacctgccttggcctcccaaagtgctggcattacaggtgtgagccaccgtgcccggccgggactatgttttatatgtgtgtgccgaacactctgagaagcagcacagacactcatttagatgggtttttgggtagtctaagtcagtgcttctcgaatgatctttgatgaagaaccaattttggcgggggggaaatatgtcattgactgataaagtctgttgatattgaggcaatatcaaattactataaacgtttcttttttttttttttttttgagatggagtctccctctgtcacccaggctagagagcagtggtgagatcttggttcactgcaacctctgcctcctgggttcaagcgattctcctgcctcagcctcccaagtagcagggattataggcgcgtgccaccacactctgctaatttttgtatttttagtagagatggagtttcaccatgttggtcaggctggtctccaactcctgacctcgtgatccgcctgccttggcctccccaagtgctgggattacagatgtgagccaccgcacccggcctactataaacgtttctaaactcctgtcagtttttgtgctatttcattgtggatcagttaccaacagtttatggaccaccagtgcactgagaagcattggcttccagacagacatattagcatttgaagataattctgggctagaagtaagaagtagtgatgtgggaacagagatctgtttggtaagaatggaataatacatagcagcaaaaagtagaaggcctctgtagctcagcctctcttaggctttctgtcctggaggcaaagaaagaggtttaccaagcagacatttccactgatccgggagaaagcctggcaggccacaatccggttcttccattgacagctgttcagctccacagcaagcatggtgtgtatcagggtctgaggaaatggaagacttgtatggatattcacaatcacttttagagatactagaaccttgaagttacattctgaaatggcatcctgcataattaatgtcaccagtgggcttacaagagatggggcatgtttccatcacagccaactgactctgggatcataaattggggaacaaaatacaaatttaataacttaaacagaaaactgggaccttcctttcctgactttaactgtttttttttttttttttttttctgagaaggttgtcccccaggctggagtgcagtggcacaatctcggctcactgcaacctccgcctctcgggttcaagtgattctgttgcctcagcctcccaagtagctgggattacaggcgcctgccaccacgcccggttaatttttgtatttttagtagaggcggggttttaccatgttggtgccaggctggtcttgaattcctgacctcaggtgatctgcctgcctcggcctcccaaagtgctgggattacaggcgtgagccaccgtgcccggccttctgtctttaactgtttttacccctaaaatgatttttatatgcctcaagcttatgactttcacatttctattgaaagtaactaaacacaaatataggcctctgcagttttcaatggtaaacttctagcagaagcaaattctacatgtcagaactcttcttgcatatgcaaatagagaccatttgcaacctaattctcacttttctctcagctaactattgtgacttccctttgtatacacctctacacccaggtttactcatgcttattctacgtttacttatgcttgagattgtcaacccaaccggctgcattttatctaattaattaattgtgtaattaattttttgaggcagggtcttgctctgtcgctcaggctggagtacagtggtgtgatctcagctcgctgcagccccaacctgccaggctcaagtgatcctcccacctcagcctcttgagtagctaggattacaggcacataccaccatgcctgactaattttatttctttttttgtagagacagggtctcactatattgcccaggctggtcttgaaatcctggactcaagggatactcccacctcagcctcccaaagtgctgggattacaggcgtgagcgaccatgcccagcccagctgcattttattttatttgtttgagacagagtcttgctctgtcacctaggctggagtgtagtggcgtgatctcagctcactgcaaccttcacctcccaggctgaagtgattttcatgcctcagcctcccgagtagctgggactactcagtgtggtaccactgcacctgtctaatttttttatttttagtagagatgaggtttcacccatgttggccagtctggtctcgaactcctgacctcaagtgatccacctgcctcggcctcccgaagtgttgggattacaggcataagccactgccccggccccagctgcatttcagattgcttacattcactgacctcaaagacctaattgctccccaaaactgtgtctgacccggtaatggacacatactgtcttctcactcagatagctcaggaggatataagactgttcctcagtgtcctcattcttctttgtaaacagctggtggaggatcctcttaatcacagggtaagtagcagtaccttccagagccaagcactgagctgcagcccagctatccacactgttacctgccacagttgggtgaaaaagagttcagaatggtgatgtgttttccccctagagaacagcctttggattgatacccaaggctgctaccccacctgatatctcacttccttgtgccccactcagtctagaaatacaatttcttatttaaaccatattgagaagaatcatattggctgggcacggtggctaacacctgtagtcctcacattttgggaggccaaggtgggcggatcacctaaggtcaggagttcaagaccagcctggccaacatggtaaaaccccatctctactaaaaatacaaaaatcagccaggcgtggtggcatgcgcctgtaatcccagctacttgggaagccgaggcaggagaattgcttgaacccaggaggcggaggttgcagtgtgagctgagatcccaccattgcactccagcctgggcaacgagagtgaaactctgtctcaaaaaaaaaaaaaaaaaaaaaaaaaatttagtccagctaccacttggtggcagtgtacctgttttgttaaagtacctagaaagagcaaattttctttttttccttttttttagagacagggtcttgctctgtcacccaggttggagtacagtggcaccattgtggcttattgcagcttcaaccccctgggctcaagctgactctgataagcatgtatatataggtctgcctcagcctcctaggtagctgggtctacaggagcacaccaccgcacctggctaattttaaaattttttatagagatggggtcttgttatgttgcccaggctggtttagaactcctatgctcaggtgatcctgtcgccttggcctcccaaagtgctgggattacaggtgtgagcgacagtgtctggtcctaattttcaaatggtctaacataaatctaaacccaatacagcagacattgcagagcatcacagtggagaggaaaggactgggaaagctgatagtgagatgtctatcccatatttccaggtcagaagtaacagggagttactcacccttcagaagggcagtctgcatgatgttccgggcaaggggattatgtgactgtatggcatattggcatattgctgctgccatccgcacatgggcattcttgtcacaaagagcagcctctagggcaggcagtagaacctccggcaagtcctggatggtcttgtctgtgatcaaaagagccaggtaagagagtactagcccctttgcttttctcacacacagcttccttcctacagccatgtggtggccaacctcagtcccagctgcagttgcttagtgctatgtaatataattacagtttagctgagcccttcagatgggcaggattttctgctcaaggtgttaaagctcacctgtgtgctggtatgccaattcccaatcctttatcatctggcctctaaacagctatatttaagccgaagaagaatgtttccagctaggctacagtgaactacaccattagttttagtgattaaaagcaaccaatttgccccatgagcccatatatatatatatatatatatatatatatatatatatatatatatatatatatatatttatttattttatatattttttgagacggagtcttgttctgtcacctgggctggagtgcagtggtgtgatctcagctcactgcaagctccgcctcctgggttcacaccattctcctgcctcagcctcccgagtagctgggactacaggcacccagctaatttttagtattcttagtagagatgggatttcaccgtgttagccaggatggtctcgatctcctgaccttgtgatccacctgcctcagcctcccaaagtgctgggattacagacgtgtgccaccgcccccagctgagcctttatatttgtaagaacaattatatttaggtagtgctttataatatagtgtttttacattatcttgttatctttcaaccttggttgaattaggcaaggtaggtatcattgtagagctcactagggagtcttttttggttcaactaaacagtaaggttcataagactgtcatgggccatgcatggcaccagaagaatatgggacaggagcatagtttgtcaacagggcagcagcatcaggcatccctgttggctggagtttttttgtttttgtttttgttttttttttgagatagagtttttgctctgttgcccaggctggagtacaatggcacaatcttggctcactgcaacttctgcttcctgggttcaggcgattcttctgcctcagccttccgagtatctgggactacaggcacctgtcaccacgcctggctaatttttgtatttttggtagagatgaggtttcaccatgttggccaggctggtcttgaacccttgacttcaggtgatccacctgccttggccttccaaagtgctggaattacaagtgtgagccaccacacctggctttggctgcagttcttgaggctgtcttgagcattccacagagtcttggggacagcacaggagcatgttgtttattcactgggtgaatttatgctttacaggaactaatatctcttataaaaactccatagacacaattctagggtccacaaagggcctgcctgttataagttacagtatccagggaggcccaaactatggtgtccctatcaagtatttatatttcacttatagctcttctcagtcccaatgtaatttatcaaacaggatttatatcataaccaatgttgcctataaagatagttcttatcaggtgtttaggggaacaggtgggcatttaactgaagttcaaattctcaagtaggaaggggaaaggtttgttatccctttgtctaccactagtctcattttatagataggtaatttgaagctcagagaggttagctgactgcccaaggagtggcacagctaagcccgtgaatcatattttaagattttgtcaggtgcggtggctcatgcctgtaatcccagcactttgggaggctgaggtgggtggatcacttgaggtcaggagttcaagaccagcctggccaacatggtgaaaccccatctctactaaaaatacaaaaaaatgagctgggcatggtggcacacgcctgtatgtagtcccagctactcgggagactagggcaggagaattgcttgaacctgggaggtggaggttgcagtgagcagagatcgcgccactgcactccagcctgggtgacagagcaagactctgtctcaaaaataaataaataaataaataaataaataaataaataaataaataaaataaaataaaaaagaatgggctcttggctgggcacagtggctcacgcctgtaatcccagcagtttgggaggttaaggtgggaggattacttgaggccaggagttcaagactagcctggtcaacatagcaagacacagtctctaccaaaaacaaaaacaaaaaagaatgggatcttcaaggtgggaaatgttaacttctctgcaggccactgagcaaacaaaaggtgatgaaatgtagttcaaaaattactggactagaagtctggaattttaatctcgtctctattgctgataagcatgtatatataggccagtctctaagtcttggtttccacatttgtaaaatgatctcagataagccctgggtccctaccagttcagatgttccatggctttatgagttgcttatgttctcaagcagttcagctttggctctcacctgagtctctctggctggtggcaatccggggccgttccaaagcagctgtggcacatgtggtgatagctttgatccgaacgtcatcatgcaggtctcccaagctctgaagcaggttctctactgtctcatggtgccactctatgactgagccgcagtgagggaaatgaaaagagaaccacctggttagggttagatattgtgctgcaggcaggtgacaagaagtctgcccttcacccagaataattcaagcaaaacattagctcagaagaataaagggcccagagatggggtctttagggagttatttctctgatgatccatgtaccctcacaagtaagttcccagacaaaacttctcccaaccccatcgtatctatctctctttctttaaatcacttttcgttgtaaccatctgggaaataaaagtgacaataaaacaaagtagttaagagtactttgttttcagacatacctggtttgggatcacagttattagctgtgtgactgtggataagttacttaaccctgagcctgagatttcttatttgtaatacaggcataatactagaacccacatattgagttattcttactgttaaatgagttaactagacaaagtgtttagcaaaatgcctggcaagataatgaaggttcaataaatgttaactattgtggttttcattaggttctttgtctttgagggcacttccatttggctttcaacatcttcctcattttagttgctaaatactcttttggcaggtatcagacttttatttcaaagctcctattatctgtaggtgtttccttcagtcttttttgttattgtttatctgatccagtttacctaatggattgcctctctttttcctgcactaactaagcttgtctatcatgttctgaaagccagcagctattgagttctcaaataccatagctttcaacagtccttgccaggccattactttgtcccaggcactcagacttctactctcctatctttgaaggcaaagtaggtataggatagccccaactctacgaatgaattttggagaggggttgctgataccatagtcaactatgacatggacaatggttggacagcatattttgttcttcccttcatacatcatttgctgagcataaagtttggaaaacaataagatagggtcgcctgggtgcagtggcttatgcttgtaatcccagcactttgggaggccaaggcggggagatcacctgaagtcaggagttcgagaccagcctggccaacatggtgaaaccgtgtctctactaaaaacacaaaaattagccagacatcatggcacatgcctatagtcccagctacttgggaggctgaggcaggagaatcgcttgaacctgggaggtagaggttgcagtgagcccaaatcaagtgccatggcactccggcctgggcaacagagtgaaattccatctcagaaaaagaaaaaagggctggcgcggtggccaaggcgggcagatcacctgaggtcaggagtttgagaccactctggccaacatggtgaaaccccatctctaccaaagatacaaaaagttaaccaagtgtggtggcgggtgcctgtaatcctagctactcaggaggctgaggcaggagaattacttgaaaccaggaagcagaggttgcagtaagctgagatcccaccgttgcactccagccaaggcaacaagagcgaaactacgtctccaaaaaaaaaaaaaaaaaaaaaaaaaaaaatggtctctgcctctgaagagtctgcagtgtaataatgagtttccacaaattactgaagtaatacccatccatgcaaaaagcacccagatatatgttaactgaagttcatctaacacccaatgtgtgaaaggctcttgtctagccttaatgaggcaaccagatttttacatttcacaaaggagggatggatttttcaaagactgagaaagcctagtcccagatgagaaccacttctcacaaacgtacagtatcacaggacctcccttcactcactcagagcccaggcagtcttccattccttcagcatcctccgcaggaccaccagttcccaggtcacatcctcctgcagtgattttgcctgcttcttcaatctcctggtcttaataggcacatccttctcacccacctgcagcagcatatccttggcgggggtgggcaaagcagtccagcgcagggctccttgcacaggtctgtaagctgtgcaacgtggcagtgtgaggtcttttcaccccactgccttaggccctgccacacagtggccccagcttgcatcccattcctattcctgactaataccaaagcaaaacaaaaccctcaagagtgaatttccccatgattatatggggaactgagtacatgtacacagggaattatggaaagtcctgactagacatggtaagccatgatgatgatgggggtgagagatttgtggggggaaattgagatatctacaaacctttctataagtttaaaggttatctttaggaacctaaatctttaggaacataaatatgtttatatgtaacgagatttgctcataatatttgatacgttgcaatttagtgtcattggccattatttctaaagtattaagttttccttttaatgtttttaatttggggagaataatagtgctataagctgtgaaattttaaagattttaacatctctgagtttttcctcaagacaacagaaatttgagaacagaagaagccgtaaatattagatatagttagaaaagctatagttggccgggtacggtggcttttgcctgtaatcccagtactttgggaggccgaggcgagcagatcacgaggtcaggagatcgagaccatcctggctaacacggtgaaaaccccgtctctactaaaatacaaaaaattggccgggcatggtggcatgtgcttgtagtctcagctacttgagaggctgaggcaggagaatcacttgaacctgagaggcggaggttgcagtgagctgagattgcaccactgcattccagcctggacgacagagtgagactccgttctcaaaaaaaaaaaacaaaaaaaaaactatagttatattttctgaacttaatgtttttcatggtgtcaaatttagaaagcctctttctcagaaaaaaagctctatggagaaggggaagggaaaaatgataaaaacatttccagatgtactaaattcattattcacactgcctattagtctcatgttctaatcagtcactatcagccatttctgtttttttccaagatttcattctgactcttaacacctttagatttgctctgaatcaattctttcctttgagcaaggaagacataacatttctttcttctaatgtaaaaagagtcctgtgaggcggggtgcagtggctcatgcctgtaatcccagcactttgggaggccaaagcgggtggatcacttgaggtcacaagttcgagaccagcctgaccaacatggtgaaaccctgtctctactaaaaatacaaaaatttgctaggcgtggtggtgggcgcctgtaatcccagctactcgggatgctgaagcagaagaatcacttgaactggggaggcggaggttgtagtgagctgagatcgcgctccaacctgggtgacaaagcgagactccatctcaaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatcaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatctaaagctggggtccctaacccccaggccatgggcctgtaccagttcatggcctgttaggaaccgggccaccacaacaggatgtgagtggtgggtgggcaagcattaccagtgagctctgcctcctgtcagatcagcagtggcattagagtcacgtagcatgaaccttactgtgaactgcacatgtgaggggtctaggctgcgcaccctttatgataatctaatgcctgatgatctgaggtggaaccatttcatcctcaaaccatccccaccccgctggtctgtggaaaaattatcttccacgaaaccggtccctggtgccaaaaaggttgaggactgccgatctaaagggagcacacaaagtaatgactcttggcagggtacagtggctcatgcctataatcccagcactttgtttgggaggctaaggtgggaggaccccttgtggccaggagttcgagaccagtctgggcaacatagtgagaccctatctctaaaaaagttaaaaattagctgagtgtagggtgcacacctgtggccctgatcctcctgcatcagcctcgcgagtggctgggactccaggtgcgtgccaccatgcccaactaagttttgtatttttttgtagagacggggtctcaccttgttgcctagactagtctgaaactgctaggctcaagcgatctgcctgcctcatcaaattgtatggtttaacaggattaattttatagtatgtaaattcaagctcaataaagctgttattgaaaaagaatcctctggctgggagagtggctcatgcctgtagttccaacactttgggagtctgaagagggtgcatcacttgagcccagaagtttgagaccagcctgggcaacacagcaagaccttgtctttacaaaaattagctgggtatagtggtgtgcacctgtagttccagctactcgggagagtgaggtggaaggattgcttgagctcaggaaggtaaaggctgcagtgagccatgattgtaccactgtgctcagcctgggaaacagagtgagaccctgtcaaaaaaaaaaaaaaaagaagaagaaaagagagagagggaaggggaggggaagggggaagagaggaaagggagacatgaaggaaggaaagggagaaggaaaggaaggaaaaaaaggaagggaggaaggagaaaagaaaaagaggctggacacggtggctcacgcctgtaatcccagcactttgggaggccgaggtggacagatcacgaggtcaagagatcaagaccatcctggccaacatggtgaaccccgtctctactaaaaatacaaaaattagctgggtgtggtggcgcgcacctgtagtcccagctactcgtgaggcagaggcaggagaatcacttgaacccaggaggcggaggttgcagtgagccgagatcacgccaccgcactccagcctgggcgacagagcgagactttatctcaaaaacaaagccaggttgtgtggaaatcctgtggctgtccacagctgtctggcgggtgcctccacagcaggcacagaatgtgcctgtgcctccaaggatagactgagcccagggaaggacttcttgccaagtggatgcaaaggcacaactagcaggccaggcaaccctgtcagccaggtgtggaggcatgcacctgtgattccagctaccctggaggctgaggcaggggaattgcttgaaccaggaagatggaggttgcagtgagcagagatcacgccactgcactccagcctgggtgacagagcaagactctgtctccaaaaaaagaaaaaaaaaaaaaaggaatgggtgacaactgctgttagtttctgcacaccactgggcccatctgaacagtaatcctacaaagagtcatgggaaatagagtcttgtggaagatgtgcacattttgtttcataagctaatttcttggtcaccttctttccctctttgtcttacagagtgaagaatgatgaacttgtgaaagttcaggtatgggtgggctgagtgtggagtgggagggtagagccagcccaagggaaaagggcagaatgctgggtcaggagtttgatgcactttccctgttaggtgcactttccctgttagcattgagataggagctgccttattggtaactagtggccctaaaccacttggttatacctaagttatatcagatctcaagtgattgtatgttcctgtgaggctcttcctagttatagttagtattttataattttgtgagattatttttagtacgtagaaaggggattgcctagatgctaatggtgcttcagcccatgaactgggagctctagcacatgaatagtgggtaatgatgggaagtagccacattcccgttattaacccctgccttccctgttagcttcctgcttacatgcttcaggaattgcctgggcactccacttttctggagtttcagggaagaccttagatagctgcttgttgtaccgatttaggttttccaggacaatctggtctctctttgcaccaatctggtggatgatctggacttcatctgtgaacagacaaagaaacaatgagtcccctataacctccctatttcctttctccctgggttcctaatcaccaggatcagacccaacttccttttgccctaatctaagcccctaggatccatgactgccatactctggggcatcccttgaaggtgaccattgcttagaaatatcacagtgataaatcactatagtgtctgtgggggaaaaaaaaaagaaaaaggaaatgtcatagctagtcacctcattagaggcctgggagccaaggatggtgatttccttcctaaggcagaacctatggccgggtgtggtggctcacacctgtaatctcagcactttgggaggccgaggtgggtggatcacatcatcaggagttcgagaccagcctgggcaacactgtaagacccccgtctctacaaaaaatacaaaaattagctgggtacagctactcgggaggctgaggcaggagaatcagttgagcctgggaggtggaggttgcagtgaagatagcaccactgcactccagcctaggcaatgggagtgaaaccatttcaaaaataagaaaagaaccggctgggcaccatggctcacgcctgtaatcccagcactttgggaggctaaggagggcggatcacaaggtcaagagattgtgaccatcctggccaacatggtgaaaccctgtctctactagaaatacaaaaattagctgggcgtggtgatgcgcgcctataatcccagctatttgggaggtggaggcagaggttgcagtgagccaagattgtgtcactgcactccagcctggcgacagagcaagactccgtctcaatagaaaagaaaacaaaagaaaagaacctatgtaaccacttagaggccttatcccttataaaaagctagatactaaaaaagaggcacctaattaatctcatcagtcatgaatacttagagtaattttgttaaacactttgagaagactttcagctgcagcagtttaggaacaagatggggcttgggaagaagaaacagcttggaacacgaagacctagattgagtatcctggaagcccaggcatctaagggacagcagtagggacagggaaggtggcaaacatttactgaacaccttaaacagacattgagcaagaagcattacagatgctttctcatctactctactcaaagtgcatttttgttaacatcacttcacaaataaggtacttgtggctcagaggaattatataatttactgaaggttactaaaaaaatactgagccaggatttaaacccaaatgtgcctgactccaaagccctgattttttccaacatagcaccttggtgggagaatatctcgaagtgggagaatatctcgaagtgagagaagggagaagggtagatagagaagagatggattgttcccaaagtcttgccaactttacagttccacccttcattgcctctttagtaagatagagggatagagaaagcggggagagagagcagttccctccctattagttatcactccccgacccaactcctgtgctagtgtgggtgctgggtcatgaacatgaaaacctgggtcatccagggcctcttgtccatacccacaactgtttccagcccccagcaatcttccaccttcctggcccatgtccccgtgtgcccctaccacaggggcccagctctattaccaaagtaaatctcctgttcaaaggtgttgtctgtggagtaggcaaactttccagctcggggagtcacctggcgaaagtagctctgggtttggggctgggagaggctcgtcttttcatggatatcctcagtgctcttgttgccaggcatgatctcaactgtctctgcttgttggaagtaactgggcaatcttggcaggggtgagaaaggagggaaaagggggaaagagtaggaggtggatccccctttccattaaatccacagctcgttccctttcctctttaagctcagctcctatacacgtgagcattgcagaacaccaatgtttaacttttagccttgtccccatggtgccagttgaatgtggagctgccagaagggcctgtctacagctgtcctgcctggctactaaaggatccatgccttctgcagccaccaagcagcagggcagagtggcggtgctccagcataacccttttttaacattcgtactcttagaggcggcatggccttggggaagggatcccacctccttcgtcatctcactctgtctattctgtgtgtggttatttaatgtccatccacctggtggtggacaggctgtaagctccttaaaggtacatatctgtgtctgttgcttttacattgtattcccagcactttgcagagtgcctggaaagtagcaagaacataatttatatttgtccaataaatgaataaataaatggatttccactgatttttagttcactcttggaaatcagggatagtgtaatagctccagtcttccctctagctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcc

SEQ ID NO: 137 - DNA, 41027 bp, Homo sapiens
accacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcctaaacagttgaaaaatgggatgaggactcatttcatccccagatgactacctataaggagtgattggctaggtgggtggctcacgcctgtaatcccagcactttgggaggctgaggcgggtggatcacccaaggtcaggagttcgagaccagccagcctgatcaacatggagaaaccccatctctactaaaaatacaaaattagccaggcatggtggcacacacctgtaatcccagctacttgggaggctgaggcaggagagttgcttgaacctgacaagcagaggttgcagcgagccgagatcgtgccaccgcactccagcctggataacaagagcaaaactctatctcaaaaaaaaaggagtgatttagggtgtccacagataaatgccctttagcctttgacataaagaatctttagttacaatgcaaacatcccagaaagaataccatattaccattatcaattattagaaattcttaaggaggctgggtgcggtggctcacgcctgtaatcccaacactttgggaggctgaggcaggcagatcaccagaggtcagcagttcaagagcagcatggccaacatggcgaaaccccatctctactaaaaatacaaaaaattagccaggcatggtggcaggcacccgtaatcccagctactcaggaggctgaggcaggagaatcgcttgaacccaggaggcggaggttgcagtgagccaagatcacaccagtgcactccaggctgggtgacaagagtgaaacttcttctcaaaaaaaaaaaacaaaaaaaacttaaggaatagttattatcatccgatatgatggcttattaagaaggaagggaacacatgataggtctgttttgaaaaggaatggggacagaacaaaatgttacacaaggtctgatcaaaagaggcttgttctggcttgtctttgtctgtcttggagtcacgggacaggtgtaaggccaaattgtgcacttcccagtcatgttaccttgggcaaataatttgaaatctgtagtttcccaatctgaaaattgagtctgatacctgttctaatttagtgttgattgatatgaacctcaaaattagaaacgtatgaaagttctttgcaaactaaaatatatgtgtgaggaattgttattattagtttagaggatggactgttgtccttagaaggcaagtctctgggtcctacagttagatgcactgggcgcttcgggaagaatttagggctatggggtactcagcaattaaaagagagggtgcttagagaagaaagaaaggacttattaatggagtttggaggctccttattatcgaaacttacacattacgtgaccagcattatgaggcagcaccccactcccaacaaatagccctctagaaccaaaagcagagtggcaggtccggggtccttttgtacatagacggcataaaaaattgactaagtcaatcctggcataactgcagaccaggccctggaatgagcaacccaccagcattatctgcatttctaggaacttgggctagaaggggaggaatggggttggaagggttaggccacatgcctctagttaaaacctgatgaacttcctagatccccagctggaaaacgtaggagttggactaaattcctctcctgcctctaatattttatgaatacagaactcaactcaaactgggtagtatctcagagattccaaatttagttccacttttctgtttgcttatcagtcgcttaccctcaccctctggtctgatacctttatcctgtacaagtggtcaaagtaggttgagtaacatgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaacttttttttgtagagacagggtcttactatgttgtccaggctggtttcaaactcctggaatcaagtgatcttcctgccttggcctccagaaatgctgggactatgcctggaatagatatgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaattttttaccatgcactcacacagctatacagctatctccagagattactctggaaactctgctataaagatgacctggtctaatgccttgatttgtttttttttttttgagacagggtctcactctcctggagtacagtggcgtgatcatgactcactgcagccttgacctcctgggctcaagcaatcctcccacatagctgggagcataggcacatagcacaccactctcggttaaatttttttttttttttttttttttgtagagatagagtctcactatgttgctcaggctggtcttgaactcctggactcaaacagtcctcccaccttggcctcccaaaatgctgggaatacaggcatgagccactgcaccaggcctaatgtcctgattttataaatcccaaaactggggcccagagagaagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctaaaaggcagtcctcagagagaagcaaggttctgcatcttaagccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctttgagaaattgcatcttatttattgattatttattgaatggtagtttcatggagtttttggtcttttttcttttttgagacagtctcactcagttgcctaggctggagtgcagtggtgcgatctcggctcactgcaacctgtgcctcccaggttcaagcaattctcctgtctcagcctcccattacaggccacaccaccatgccccactaattgtacttttagtagagatggggtttcaccatgttggacaggctgttctcaaactcctgacctcaagtgatgtgtccgccttggcctcccaaagtgctgggatttgcaactgtgagccaccacacctagcctcttggtcattctttgaaaaataaacctcagccaggcgcgatggctcacgcctgcaatttcagcgctttgggaggctgaggtggcggatcacctgaggtcaggagttagagaccagcctgaccaacatggtgaaaccccatctctactaaaaatagaaaatttaaaaagaaaatcacctgggcctggtggcgcatgcctgtaatcccagctactcgggaggctgaggcaggagaatcgcttggacccaggaagcagaggttgcagtgagccaagatcaggccattgcactccagcctgggcagcaagagtgaagtgcagtctcaaaagataaaaataaaaaaaccctctagatatatgcagctccatattctcccaccacaagggtttataaatcctgagaaagaggcaaagcagggaacacatgaccacatagttctggcaggcgtcagattaccaggctgataaaacagatggtaaagtagaagctgtccgtcgacttttccattcccctttcagctcctccactgctacttaatctcctttgcccacacagttcaatcccattttccctgatctctaaatcctggctagattattagccattaacactagcttttacaaggagactcttcaatcttgtatttctaatagtataatttcacacgtacagaaattctttaagtcatagaagtcttacagatacagaaattctgatcttcaagagtccctttgtgaaacaaactaatttatcctgacagcaggaaagatttctgggcctaaggctctgtctcgttgacccaggtcatgctattcaggtggtccatctcttggttccaagcaagactgctgctgctgaccaacctgaatatggactttagcacttgagctcaagctgcactcagatggttagacccccataaaaagcagagggtacgttttctgttatgaaaagtaaagactgagccaggcgctgtggctcacgcccataatcccagcactttgggaggcaagttgggcggatcacgaggtcaggagatttaaaccatcctgggtaacacggtgaaaccccatctctactaaaaatacaaaaaaattagccaggcgtggtggcaggcgcctgtagtcccagctacttggaggctgaggcaggagaatggcatgaacccgggaggcggagcttgcagtgagccgagattgggccactgcactccagcctgggcgacagagcaagactccatctcaaaaaaaaaaaaaaagaaaattaaatactaaaaaaattaaacattataaccctgctaaggcaggaggatcatttgagcccaggagtttgaggctgcagtgagctatgatggcactactgcaccccagcctcagtgacagagggagaccctgtttctaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggctgggcgtggtggctcaggcctgtaatcccagcactttgggaggccgaggagggtggatcacctgaggtcaaaagttcaagaccagcctggtcaacatggtgaaactccatctctactaaaaatacaaaaattagccaggcgtagtggcaggcgcctgtaatcccagctactcaggagaccgaggcaggagaatctcttgaacccaggaggcagaggttgcagtgagccaagatctcgccattgtggtccagcccgggcgacagagcgagagtttatctcaaaaaaaaagaaagaaaaaaaaagaaaaaggaatgaaatgggccaggtgcagtggctcacgcctataatcccagcactttgggagcctgaggcggacagattactcaaggtcaggagttcgagaccagcttggccaacacagtaaaccccgtctctactaaaaatacaaaaattagctgggcatggtggcacacacctgtagtcccagctactggggaggctgaggcaggaaatcacttgaacccaggaggttgcagtgagccaagcaagattgcaccactccaccccagccgggcaacaagagtgaaactctgtctcaaaaaaaatgaatgaaatggctgtgtgaggtggctcatgcctatgatcccagcactttgggaggccgaggtaggaagattgcttgaatgtagaagttcaagaccagactgggcaacaaagtgagacccccatctctacaaaaaacttaaaaagtatccaggtgaggtggcacgtgcttgtcgtcccagctactggggagactgagatgggaggattgcttgcacctgggtgttgagactgcagtgaactgtgatcttgccactgcactccagagcctgggtgacagagcaaaattcctggggagagtgaagttatgatatgctgtaaatatatggatgagccttgaagacaatatgctaagcaaaataagccagagatgaagggccaaatactgtataattacactttatgaggtacctaaagtagtcaaattcagagacaggaagtggaatagtggttgccaggggctggtggcagtggggaataaggagttattgtttaatgttgtgggaagtcaaggaccccgaatggagggaccggctggagccgcggcagaggaacataaattgtgaagatttcatcttaatatggacatttatcagttcccaaataatacttttataatttcttatgcctgtctttaatatcttaatcctgttatgttcgtaagctgaggatgtacataacctcaggaccactgtgataattgtgttaactgtacaaattgattgtaaaacatgtgtttgaacaatacgaaatcagtgcaccttgaaaaagaacagaataacagcgatttttatggaacaagggaagacaaccataaggtctgacagcctgcggagtcgggccaaaagagccatatttttcttcttgcagagagcctacaaacggacgtgcaagtaggagagatatcactaaattattttcctagtaaggaatattaatattaataccctgggaaaggaatgcattcctggcgggaggtctataaacggccgctctgggaatgtctgtcttgtgccgttgagataaggactgagatacgccctggtctcctgcagaaccctcaggcttactagggttgggaaaactccaccctggtaaatttgtggtcagactggttctctgctctccaaccccgttttctgttgtttaagatgtttatcaagaaaatacatgcaccgctgaacacaacccttatcagtggttctgcttttgccctttgccttgtgatctttgttggacctttgtcagtggttctgcttttgccctttgtcctattccctcagaagcatgtgatctttgttagaaccttattagtggttctgcttttgccttttgaagcatacgatctttgtacccactccctgttcttacccccgctccccttttgaaacccttaataaaaacttgctggtctgagactcaggtgggcatcacggtcctaccaatatgtgatgtcacccccagcggcccaggtgtaaaattcctctctttgtactgtctctatttgtcagccggccgactcttatagaaaatagaaggaacctacgttgaaatattgggggcgagttcccccaatagtttaatgggtaaagactttcattgtacaatgatgtaaaaattctgggccagacgcagtggctcacgcctataatcccagcactttgggaggctgaggcaggccgatcacttggggtcaggagtttgagaccagcttggccaacacagtgaaatcccatctctactaaaaatagaaaaattagctgggtgtggtggtgcgtgcctgtagtcccagctactcgggaggctgaggtaggagactcacttgaacccgggaggtggaggttgcagtgagctgagatcgcgccactgcactccagcctgggggatagagcgagactccaaaagttctggaaatggataatggtgatagttgtacaacaatgtaatgtacttaatatcattgatttgtacacttaaaaatggttaaaatgggcttgttccagcagctcatgcctgtaattctagcgctttgggaggccaaggcaggagggtcacttgagaccagagttcgagaccagtctgggcaacatagcaagaccctgtctctaaaaataaaaaaataaataaataaatggttaaaatgaggccatgcatgcctgtaatctcaccgctttgggaagatgaggcggtagggtcacttgtttgggaagaggaggtgggaggatcctttgaacccaggagttcaaggctgcaatgaactatcatggtgccattgcactccaacctgggtgacagagtaagacctagtctctaaaaaaataagagttaaggccagacacggtgactcacgactgtagtctcagcactttgggaggctgaggcgggcagattacaaggtcaggagtttgagaccagcctggccaacatggtgaaaccccgtcgtactaaatatacaaaaatcagctggccgtggtggcatgtgactgtaatcccagctactcaagaggctgaggcaggtgaatcgctggaacccgggagccagaggttgcagtgagccgagatcagaccactgcactccagcctgggtgacagagcaagactctgtcttgaaaaaaaaaaaaattaaaaaaagaaacatggcccagtgtggtggctcttgcctataatcccaacactcagggaggccaaggtgggaggattgcttaagcccaggagttcgagaccaggcaacatagggagaccccgtctgtacaaataattttaaaaattagccaggtgtggtggtgcatgcctgtggtcccaggtgctcaggaggctgaggtgggaggactggctaagcctgggaggttgaggctgcagtgagctatgatcacaccactgcactccagcctgggtaacacagtgagacaccccgtcttaaaaaacaaacaaacaaataaacaaatactatgcataaaacctcaaggctcaagaaacaacagtttgaaatagttagatgtgtgttttttaattttcatgtcttatcttttctgttttttgtttttttttttttttttttagagatgagatcttgctctgttgcccaagctggtatcgaactcctcctgggctcaagcaatctcctgcctaggactccctcctaacagctggaactacaagcatgaaccactgcacccagcta

SEQ ID NO: 138 - DNA, 31812 bp, Homo sapiens
accacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcc

SEQ ID NO: 139 - DNA, 13302 bp, Homo sapiens
ctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagcta

SEQ ID NO: 140 - DNA, 53940 bp, Homo sapiens
ctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcctaaacagttgaaaaatgggatgaggactcatttcatccccagatgactacctataaggagtgattggctaggtgggtggctcacgcctgtaatcccagcactttgggaggctgaggcgggtggatcacccaaggtcaggagttcgagaccagccagcctgatcaacatggagaaaccccatctctactaaaaatacaaaattagccaggcatggtggcacacacctgtaatcccagctacttgggaggctgaggcaggagagttgcttgaacctgacaagcagaggttgcagcgagccgagatcgtgccaccgcactccagcctggataacaagagcaaaactctatctcaaaaaaaaaggagtgatttagggtgtccacagataaatgccctttagcctttgacataaagaatctttagttacaatgcaaacatcccagaaagaataccatattaccattatcaattattagaaattcttaaggaggctgggtgcggtggctcacgcctgtaatcccaacactttgggaggctgaggcaggcagatcaccagaggtcagcagttcaagagcagcatggccaacatggcgaaaccccatctctactaaaaatacaaaaaattagccaggcatggtggcaggcacccgtaatcccagctactcaggaggctgaggcaggagaatcgcttgaacccaggaggcggaggttgcagtgagccaagatcacaccagtgcactccaggctgggtgacaagagtgaaacttcttctcaaaaaaaaaaaacaaaaaaaacttaaggaatagttattatcatccgatatgatggcttattaagaaggaagggaacacatgataggtctgttttgaaaaggaatggggacagaacaaaatgttacacaaggtctgatcaaaagaggcttgttctggcttgtctttgtctgtcttggagtcacgggacaggtgtaaggccaaattgtgcacttcccagtcatgttaccttgggcaaataatttgaaatctgtagtttcccaatctgaaaattgagtctgatacctgttctaatttagtgttgattgatatgaacctcaaaattagaaacgtatgaaagttctttgcaaactaaaatatatgtgtgaggaattgttattattagtttagaggatggactgttgtccttagaaggcaagtctctgggtcctacagttagatgcactgggcgcttcgggaagaatttagggctatggggtactcagcaattaaaagagagggtgcttagagaagaaagaaaggacttattaatggagtttggaggctccttattatcgaaacttacacattacgtgaccagcattatgaggcagcaccccactcccaacaaatagccctctagaaccaaaagcagagtggcaggtccggggtccttttgtacatagacggcataaaaaattgactaagtcaatcctggcataactgcagaccaggccctggaatgagcaacccaccagcattatctgcatttctaggaacttgggctagaaggggaggaatggggttggaagggttaggccacatgcctctagttaaaacctgatgaacttcctagatccccagctggaaaacgtaggagttggactaaattcctctcctgcctctaatattttatgaatacagaactcaactcaaactgggtagtatctcagagattccaaatttagttccacttttctgtttgcttatcagtcgcttaccctcaccctctggtctgatacctttatcctgtacaagtggtcaaagtaggttgagtaacatgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaacttttttttgtagagacagggtcttactatgttgtccaggctggtttcaaactcctggaatcaagtgatcttcctgccttggcctccagaaatgctgggactatgcctggaatagatatgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaattttttaccatgcactcacacagctatacagctatctccagagattactctggaaactctgctataaagatgacctggtctaatgccttgatttgtttttttttttttgagacagggtctcactctcctggagtacagtggcgtgatcatgactcactgcagccttgacctcctgggctcaagcaatcctcccacatagctgggagcataggcacatagcacaccactctcggttaaatttttttttttttttttttttttgtagagatagagtctcactatgttgctcaggctggtcttgaactcctggactcaaacagtcctcccaccttggcctcccaaaatgctgggaatacaggcatgagccactgcaccaggcctaatgtcctgattttataaatcccaaaactggggcccagagagaagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctaaaaggcagtcctcagagagaagcaaggttctgcatcttaagccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctttgagaaattgcatcttatttattgattatttattgaatggtagtttcatggagtttttggtcttttttcttttttgagacagtctcactcagttgcctaggctggagtgcagtggtgcgatctcggctcactgcaacctgtgcctcccaggttcaagcaattctcctgtctcagcctcccattacaggccacaccaccatgccccactaattgtacttttagtagagatggggtttcaccatgttggacaggctgttctcaaactcctgacctcaagtgatgtgtccgccttggcctcccaaagtgctgggatttgcaactgtgagccaccacacctagcctcttggtcattctttgaaaaataaacctcagccaggcgcgatggctcacgcctgcaatttcagcgctttgggaggctgaggtggcggatcacctgaggtcaggagttagagaccagcctgaccaacatggtgaaaccccatctctactaaaaatagaaaatttaaaaagaaaatcacctgggcctggtggcgcatgcctgtaatcccagctactcgggaggctgaggcaggagaatcgcttggacccaggaagcagaggttgcagtgagccaagatcaggccattgcactccagcctgggcagcaagagtgaagtgcagtctcaaaagataaaaataaaaaaaccctctagatatatgcagctccatattctcccaccacaagggtttataaatcctgagaaagaggcaaagcagggaacacatgaccacatagttctggcaggcgtcagattaccaggctgataaaacagatggtaaagtagaagctgtccgtcgacttttccattcccctttcagctcctccactgctacttaatctcctttgcccacacagttcaatcccattttccctgatctctaaatcctggctagattattagccattaacactagcttttacaaggagactcttcaatcttgtatttctaatagtataatttcacacgtacagaaattctttaagtcatagaagtcttacagatacagaaattctgatcttcaagagtccctttgtgaaacaaactaatttatcctgacagcaggaaagatttctgggcctaaggctctgtctcgttgacccaggtcatgctattcaggtggtccatctcttggttccaagcaagactgctgctgctgaccaacctgaatatggactttagcacttgagctcaagctgcactcagatggttagacccccataaaaagcagagggtacgttttctgttatgaaaagtaaagactgagccaggcgctgtggctcacgcccataatcccagcactttgggaggcaagttgggcggatcacgaggtcaggagatttaaaccatcctgggtaacacggtgaaaccccatctctactaaaaatacaaaaaaattagccaggcgtggtggcaggcgcctgtagtcccagctacttggaggctgaggcaggagaatggcatgaacccgggaggcggagcttgcagtgagccgagattgggccactgcactccagcctgggcgacagagcaagactccatctcaaaaaaaaaaaaaaagaaaattaaatactaaaaaaattaaacattataaccctgctaaggcaggaggatcatttgagcccaggagtttgaggctgcagtgagctatgatggcactactgcaccccagcctcagtgacagagggagaccctgtttctaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggctgggcgtggtggctcaggcctgtaatcccagcactttgggaggccgaggagggtggatcacctgaggtcaaaagttcaagaccagcctggtcaacatggtgaaactccatctctactaaaaatacaaaaattagccaggcgtagtggcaggcgcctgtaatcccagctactcaggagaccgaggcaggagaatctcttgaacccaggaggcagaggttgcagtgagccaagatctcgccattgtggtccagcccgggcgacagagcgagagtttatctcaaaaaaaaagaaagaaaaaaaaagaaaaaggaatgaaatgggccaggtgcagtggctcacgcctataatcccagcactttgggagcctgaggcggacagattactcaaggtcaggagttcgagaccagcttggccaacacagtaaaccccgtctctactaaaaatacaaaaattagctgggcatggtggcacacacctgtagtcccagctactggggaggctgaggcaggaaatcacttgaacccaggaggttgcagtgagccaagcaagattgcaccactccaccccagccgggcaacaagagtgaaactctgtctcaaaaaaaatgaatgaaatggctgtgtgaggtggctcatgcctatgatcccagcactttgggaggccgaggtaggaagattgcttgaatgtagaagttcaagaccagactgggcaacaaagtgagacccccatctctacaaaaaacttaaaaagtatccaggtgaggtggcacgtgcttgtcgtcccagctactggggagactgagatgggaggattgcttgcacctgggtgttgagactgcagtgaactgtgatcttgccactgcactccagagcctgggtgacagagcaaaattcctggggagagtgaagttatgatatgctgtaaatatatggatgagccttgaagacaatatgctaagcaaaataagccagagatgaagggccaaatactgtataattacactttatgaggtacctaaagtagtcaaattcagagacaggaagtggaatagtggttgccaggggctggtggcagtggggaataaggagttattgtttaatgttgtgggaagtcaaggaccccgaatggagggaccggctggagccgcggcagaggaacataaattgtgaagatttcatcttaatatggacatttatcagttcccaaataatacttttataatttcttatgcctgtctttaatatcttaatcctgttatgttcgtaagctgaggatgtacataacctcaggaccactgtgataattgtgttaactgtacaaattgattgtaaaacatgtgtttgaacaatacgaaatcagtgcaccttgaaaaagaacagaataacagcgatttttatggaacaagggaagacaaccataaggtctgacagcctgcggagtcgggccaaaagagccatatttttcttcttgcagagagcctacaaacggacgtgcaagtaggagagatatcactaaattattttcctagtaaggaatattaatattaataccctgggaaaggaatgcattcctggcgggaggtctataaacggccgctctgggaatgtctgtcttgtgccgttgagataaggactgagatacgccctggtctcctgcagaaccctcaggcttactagggttgggaaaactccaccctggtaaatttgtggtcagactggttctctgctctccaaccccgttttctgttgtttaagatgtttatcaagaaaatacatgcaccgctgaacacaacccttatcagtggttctgcttttgccctttgccttgtgatctttgttggacctttgtcagtggttctgcttttgccctttgtcctattccctcagaagcatgtgatctttgttagaaccttattagtggttctgcttttgccttttgaagcatacgatctttgtacccactccctgttcttacccccgctccccttttgaaacccttaataaaaacttgctggtctgagactcaggtgggcatcacggtcctaccaatatgtgatgtcacccccagcggcccaggtgtaaaattcctctctttgtactgtctctatttgtcagccggccgactcttatagaaaatagaaggaacctacgttgaaatattgggggcgagttcccccaatagtttaatgggtaaagactttcattgtacaatgatgtaaaaattctgggccagacgcagtggctcacgcctataatcccagcactttgggaggctgaggcaggccgatcacttggggtcaggagtttgagaccagcttggccaacacagtgaaatcccatctctactaaaaatagaaaaattagctgggtgtggtggtgcgtgcctgtagtcccagctactcgggaggctgaggtaggagactcacttgaacccgggaggtggaggttgcagtgagctgagatcgcgccactgcactccagcctgggggatagagcgagactccaaaagttctggaaatggataatggtgatagttgtacaacaatgtaatgtacttaatatcattgatttgtacacttaaaaatggttaaaatgggcttgttccagcagctcatgcctgtaattctagcgctttgggaggccaaggcaggagggtcacttgagaccagagttcgagaccagtctgggcaacatagcaagaccctgtctctaaaaataaaaaaataaataaataaatggttaaaatgaggccatgcatgcctgtaatctcaccgctttgggaagatgaggcggtagggtcacttgtttgggaagaggaggtgggaggatcctttgaacccaggagttcaaggctgcaatgaactatcatggtgccattgcactccaacctgggtgacagagtaagacctagtctctaaaaaaataagagttaaggccagacacggtgactcacgactgtagtctcagcactttgggaggctgaggcgggcagattacaaggtcaggagtttgagaccagcctggccaacatggtgaaaccccgtcgtactaaatatacaaaaatcagctggccgtggtggcatgtgactgtaatcccagctactcaagaggctgaggcaggtgaatcgctggaacccgggagccagaggttgcagtgagccgagatcagaccactgcactccagcctgggtgacagagcaagactctgtcttgaaaaaaaaaaaaattaaaaaaagaaacatggcccagtgtggtggctcttgcctataatcccaacactcagggaggccaaggtgggaggattgcttaagcccaggagttcgagaccaggcaacatagggagaccccgtctgtacaaataattttaaaaattagccaggtgtggtggtgcatgcctgtggtcccaggtgctcaggaggctgaggtgggaggactggctaagcctgggaggttgaggctgcagtgagctatgatcacaccactgcactccagcctgggtaacacagtgagacaccccgtcttaaaaaacaaacaaacaaataaacaaatactatgcataaaacctcaaggctcaagaaacaacagtttgaaatagttagatgtgtgttttttaattttcatgtcttatcttttctgttttttgtttttttttttttttttttagagatgagatcttgctctgttgcccaagctggtatcgaactcctcctgggctcaagcaatctcctgcctaggactccctcctaacagctggaactacaagcatgaaccactgcacccagctactggtgtattgtttcagtagtctttttaaaaaatgttaatatcttggtaaaaaatatatttatactgttctctaacctgcttttttcatcagtgtgatggaaaaatgctcatcatatattcttctgctatataactttagatgtctacactgatttcatttatgacatcacaattaaactggttaaaccaaattcatattgctcacttgtttctaattttttctctattaaaatgatatgataagcatccttgtagccaaatatttacacacattcattaaggtttacttaaaagaaattcctagacgtggagctgagtcaaagagaagggatcttttaagtatttttgcactgattgccatgaaaaggtcataccagtttatacattcatcaatatatgagtttcttttctaaatcttcttcaacatcatgtgagagacagttaaagcatagttgttcagagcccaggcttgagaatcagatttcaaaggtatgaaccctctccctttttcttttccttttttttttttttttctgaggagtcttgctcagtcgcccaggctggagtgcagtggcccaatctcggctcactgcaagtgtgtccagaattggtggattcttggtctcactgacttcaagaatgaagccgtggaccctcacgggagcattacagctcttaaaggtggcatgtccagagttcgttccttctgatgttcggatgtgttcggagtttcttccttctggtgggttcatggtctcgctggcttaggactgaagctgcggaccttcgtggtgagtgttacagctcttaaggcggcgtgtctggagttgttcgtttttcccggtgagttcatggtctcgctggcttcaggagtgaagctacagaccttggtggtgagtgttagagctcataaaggcagtgtggacgcaaagagtgagcagcagtaagatttattgcaaagaacgaaagaacaaagtttccacagtgtggaagggggaccccagcgggttgccactgctggctagggcagcctgcttttattctcttatctggccccactcacatcctgctgattggtagagcccaggggtctgttttgacagggcactgattggtgcgtttacaattcctcagctagacacaaaagttctccacgtccccaccagaatagttagatacagagtgttgacacaaaggttctccaagtccccaccagagtagctagatacagagtgttgattggtgcattcacaaaccctgagctagacacagggtgctgattggtgtgtttacaaaccttgagctagatacagagtgccgattggtgtatttacaatcccctagctagacataaaggttctccaagttcccactagactcaggagcccagctggcttcacccagtggatcgtgcactggggctgcaggtggagctgcctgccagtcccgcaccgtgagcccacactcctcagcccttgggtggtcaatgggactgggctccgtggagcagggggcggcgctcgtcagggaagctcaggctgcacaggagcccacggaggcggggggaggctcaggcatggagggctgcaggtcctaagccctttcccgtgggaaggcagctaaggcccagcgagaaattgagcacagcgccagtgggccggcactgctgggggacccagcacaccctccgcagccgctggcccaggtgctaagcccctcattgcccggggctggcagggccagctggcggctccgagtgtggggcccaccaagcccatgcccacctggaactccagctggcccgcaagtgcggaacgcagcctcagttcccacttgcgcctctccctccacacctccctgcaagctgagggagacggctccggccttggccagcccagaaaggggctcccacagtgcagcggtgggctgaagggcttctcaagtgccgccaaagtgggagcccaggcagaggaagtgctgtgagggctgccagcacgctgtcacctctcacaagctccacctctggggttcacgccattctcctgcctcagcctctggagcagctgggactacaggtgcctgccaccatgcccagttaatttcttgtatttttttttagtagagatggggtttcactgtgttagccaggatggtgtcgatctcctgacctcatgatccacccgcctcagcctcccaaagttctgggattacaggtgtgagccaccgcgcccatcccctttttctttttagagacagggtcttgctatgttgtccaggttggtgcgaaactcctggccttaagcaaccctgccacctcagcctccaagtaaactgggattacaggcgtgagccatcttgcccaacttccactttctagctgtgtgatcttcagaaaatcagttaaattctctgggccttaatttactgatagggttcttgtaagtattaaccattagctactattgagaggtgaagaccgctgggcttctgggttgggtggggacttggagaacttttttgtctagctaaaggattgtaaatgcaccaatcagcactctgtgtctagctaaaggtttgtaaacgcaccaatcagcactgggtaaaaacgaaccaatcagcactttgtaaaacgaaccaatcagcactctgtaaaatggaaaatcagcgctctgtaaaatggaccaatcagcaggacatgagcagggccaaataagggaataaaagctggtcaccccagctagtagtggtaacctgcgtgagttccgctccaggctgatggaagctttgttcttttgtacttcacaataaaccttgctactgctccttctttgggtccatactgcatttcagagctgtaacaccgtgaaggtatacagcttcactcctgaagccaagaccatgaacccactgagaggaacaagaaaaacaactctggacctgctgcctttatgagctgtaacactcaccttgaaggtctgtggctttactcttgaagtcggtgagaagcgagaccatgaacccaccagaaggaacacattccggacgcatctgaacatcagaggaaacaaactccagacacactacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaaggtaattagaactgacagggaattgtatgattaatgacgtgggacatgagagatttggaacgagataaaaaggcttaccttgaggacagccttattaggagcagaggcaaacacaggttttgtgggtttgaagcctacacatttatagctttctctaattacacaggtaggaaattataaaatcaggtacaagggcttggcaggggcctaaagcttaagtgatgaaaaaaaaaaacaccacacctctggtgaaaccaatagcttacgaaaaagtagaaaaaagcgcgatgcatggggagctccggtagtcctttgaggtatttgagaggctgagtcaggaagatggcttgagcaccaggagttggaggtttgtaagtgcagtgatggtaaactgccgctgtactccagtctggcaatgtagtgagaccctgtctctcaaaaaaaaaaagtaacccttgcctgactgggacaataattgagaaaccagtaaaacaaaataataactattagccgggcgcggtggctcatgcctgtaaatcctagcattttgggaggctgaggcgggcggattacaaagtcaggagtttgagaaattactacctattaccccatttggctatttttacacttgtaaggaatgaagctcagaggtcacacagctagtaagaagccagcacccttcgatgtgggattgatgtggaggataggcatatacagagaacacaaaagcaaaacaccatggtgcagattttgaaagaaaagccctaagattagtaatgagtgtgaattattcaacaaagtgatcaaaactaactccagctctgcattcctcttcgccatcaggagtttggagcctggagactgctagctgcctggttctttaagaaccagccctggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccaggtgactcacctccgctaattgttccgtgttcgttcgcctttcactttgtgtgtctcccccgccccacgcttttcgcttatgtgtatgcccccccgccgcgcccccgggctatattgcccaggcaggtttcgaattcctggtctccagctatcttcccgcctctgcctccctaagagctgggattacagggtgagccaccgcgcccggcactttgaggggagttacactttttttttttttccgtccctgcccttttcacacgaagaagggatgtagcttccaaccttccggaggttagtgtaaagaaacaggaatggaatggaaagctgattggggaagtgtccctgccgctccaaaactgagaggtccctcaaacctagtgctcagttaaaagacattgtaagggccaggcgcagtggctcacgcttgtaatcccagcactttgggaagtctcggcgggcagatcacgagatcaaaagattgaggccatcctgactaacacggtgaaaccccgtctctactaaaaatacaaaacagtagctgggcgtagtagcgggcgcctgtagtcccagctactcgggaggctgaggcaggagaatggtgtgaacccgggaggcagagtttgtagtgagctgagatcgcgccactgcactccagcctgggcgacagagcgagactccgtctcaaaaaaaagacattgtaaggaaaggaaaaagacacttatattaaaaacaaaacaggccgggcgcggtggctaacgcctgtaatcctagcgctttgggaggccgaggccggcggatcacctgaggtcaggagttcgagaccagcctggccaacatggtgaaaccccatctctactaaaaatagaaaaattagccaggcgtggtggtgcatgcctgtagtcccaactacttaggaggttgaggcaggagaatcgctggaacccgggaggcagaggttgcagtgagctgagatcatgccattgcactccagcctgggggacaagagtgactctatcttaaaaaaaaaaaaaaaaaattcaggtagtttcaattttttaatgttcttatttatgtattgactaggaagccacttttttttttttttaaataagaattccgactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccccgctggctggctatgatctccctgttaccattccaggagagcagccgcgtccctatgcatggcaggaccaggtactattgtggcctctcctcttggcctcgaatggtatctttgtcatcagtgagcaagtccccaaagaccacggtcttgtccattgtcaggataattcactccacaagctggggctccaggtgctgccctacccagcggtgcttctcacccacacagtggtcatactttggcaggggctggtgcagtgtgaagacctcggtgttttgcatgtgcttcatctcttgcaaggtcctccggggttgggcttcaagactagggaaaagcctgggcttcacacccgtgggccactttatccaccaggtccggcagcagggtgaggtactgcttccagaccaggaagctgcggtgctgctgcagtgtcacatgcagctccctgagaaggggcggctgaagccccgcaggaggccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttgaattcgcacagtatgttaagatttatgtaaattagcatttacaataggaaaacctcttcctgtcaaatggaaatttgaggttactggatacttttatattacataaagagcaatcagccagtgtaaaaatgaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagcaacatattcatctgctctgggcaacaatttgtcttaacttacaaagttaaatatgttattctacttgtacatgtgcaccaggaggcatattccttataagaggccagatgagcagtctggattaatttaaaaaaagagcaaagtcaactggaaacagtccaaatgtccatcaacaatagaacagattaataaattgaggtatatttccagcagtcaaagtgattgaactacagctacaagaatcaacatctatcaagatatacaaaagaaaagaaaaaaaaagaatcaacatggatgaatctccaaaccactgttgagtgaaacagtcaaaccctaggagaacacattcagtatcattccatttagatacaattcaaaaactaggcaaaataaaatattaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattttttttttttttttttttttttttgagacagtgtctcgctctttcgcccaggctggagtagtggcacaatcttggctcactgcaacctccacctcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctggggttacaggcgtgagccaccggacccagcctgcattattactatttaattttgtgtgaaacacaaaacctttaatgtaaatgataaaaatatcagtaagtggagtcattcagaatgagtagccttttgagtctgtctccgttgagtaagtgcattctgttgagtgcactggagaggaatttgtgctcttctatgtagcagtctttctttttgtttcttggtggtgcaccattaaatggattcattcaccagttaaaggacatttgggttgtttccagtctttggctacaacgagtaaagtcactataaacacttgccagaggtttctggacgaacaggttttcatttctcgtgggtagatacctaggagtgggattgctgggtcacatgtgtggtaagtatatgtttaacttaaaccatccaactgtttcaggaatagcttagttttgcattttgttttgtttcttcccaagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggttagttcttctttcagatttatgggctatgatgtatcaggtctcttcttaaatggtctgggttttcacagaagttagctcattcatgacagccattccctaccccaacacacactaccttttttagtcacttcttatagacagtttctttttttgagatggagtctcactctgttgccaggctggagtccagtggtgcgatcttggctcactgcaacctccacctcccaagttcaagtgattcttgtgccccaccctcccgagtagttgggattacaggcacctgccaccatgcttggctaatttttgtatttttagtggaggcggggtttcacaatattggtcaggctggtcttgaactcctgacctcaaatgatccacctgctttgacctacccaagtgctggattacaggcatgagccactatgcccagcctaatatttgtatttttttttttttaagtagagatggggtttcgccatgttggccaggctggtctcaaactcctgacctcaagtgatctgcccaccttggcctcccagagtgctggaattacaggcatgagccaccacacctggcctcttatagacagtttctattcaattctatattactatatttcctgctagtaaagagattcgtagttgttattatgcaattttaaattccagtatttttttttttttttttttgagatggagtcttgctgtgtcacccaggctggagtgcaatggcatgatctcggctcactgcaaactccacctcccaggttcaattgattcttctgcctcagcctcccacgtagctgtgactacaggcacgtgccactactgcccggctaattcttgtatttttagtagagatgtttcaccatgttggccagactgatctcaaactcctgacctcaaatgatccacccgcctcagcctcccaaactgttgggattacaggcgtcagccaccactcccggccatgagatgatgtacttgttgatgatgactcagtttagttatgacagtgggaatgggtggctcaggtgggagacagaaaaagatcatgggagatacgagattaaggaactgagaaaccagagaataattgatagatcttccacatggttatcaccaagagtggtgatggacaaattgtggaaaggaagagatagaggggaggtaaattctcaaagttgcaaatctgggtaaatggtagaacctagattcagactcaggttcaactaacttccagggtggacacaactcaccatattccactgtttgtggaatcattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtat

SEQ ID NO: 141 - DNA, 34010 bp, Homo sapiens
ctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcc

SEQ ID NO: 142 - DNA, 30171 bp, Homo sapiens
cttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcc

SEQ ID NO: 143 - DNA, 50101 bp, Homo sapiens
cttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcctaaacagttgaaaaatgggatgaggactcatttcatccccagatgactacctataaggagtgattggctaggtgggtggctcacgcctgtaatcccagcactttgggaggctgaggcgggtggatcacccaaggtcaggagttcgagaccagccagcctgatcaacatggagaaaccccatctctactaaaaatacaaaattagccaggcatggtggcacacacctgtaatcccagctacttgggaggctgaggcaggagagttgcttgaacctgacaagcagaggttgcagcgagccgagatcgtgccaccgcactccagcctggataacaagagcaaaactctatctcaaaaaaaaaggagtgatttagggtgtccacagataaatgccctttagcctttgacataaagaatctttagttacaatgcaaacatcccagaaagaataccatattaccattatcaattattagaaattcttaaggaggctgggtgcggtggctcacgcctgtaatcccaacactttgggaggctgaggcaggcagatcaccagaggtcagcagttcaagagcagcatggccaacatggcgaaaccccatctctactaaaaatacaaaaaattagccaggcatggtggcaggcacccgtaatcccagctactcaggaggctgaggcaggagaatcgcttgaacccaggaggcggaggttgcagtgagccaagatcacaccagtgcactccaggctgggtgacaagagtgaaacttcttctcaaaaaaaaaaaacaaaaaaaacttaaggaatagttattatcatccgatatgatggcttattaagaaggaagggaacacatgataggtctgttttgaaaaggaatggggacagaacaaaatgttacacaaggtctgatcaaaagaggcttgttctggcttgtctttgtctgtcttggagtcacgggacaggtgtaaggccaaattgtgcacttcccagtcatgttaccttgggcaaataatttgaaatctgtagtttcccaatctgaaaattgagtctgatacctgttctaatttagtgttgattgatatgaacctcaaaattagaaacgtatgaaagttctttgcaaactaaaatatatgtgtgaggaattgttattattagtttagaggatggactgttgtccttagaaggcaagtctctgggtcctacagttagatgcactgggcgcttcgggaagaatttagggctatggggtactcagcaattaaaagagagggtgcttagagaagaaagaaaggacttattaatggagtttggaggctccttattatcgaaacttacacattacgtgaccagcattatgaggcagcaccccactcccaacaaatagccctctagaaccaaaagcagagtggcaggtccggggtccttttgtacatagacggcataaaaaattgactaagtcaatcctggcataactgcagaccaggccctggaatgagcaacccaccagcattatctgcatttctaggaacttgggctagaaggggaggaatggggttggaagggttaggccacatgcctctagttaaaacctgatgaacttcctagatccccagctggaaaacgtaggagttggactaaattcctctcctgcctctaatattttatgaatacagaactcaactcaaactgggtagtatctcagagattccaaatttagttccacttttctgtttgcttatcagtcgcttaccctcaccctctggtctgatacctttatcctgtacaagtggtcaaagtaggttgagtaacatgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaacttttttttgtagagacagggtcttactatgttgtccaggctggtttcaaactcctggaatcaagtgatcttcctgccttggcctccagaaatgctgggactatgcctggaatagatatgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaattttttaccatgcactcacacagctatacagctatctccagagattactctggaaactctgctataaagatgacctggtctaatgccttgatttgtttttttttttttgagacagggtctcactctcctggagtacagtggcgtgatcatgactcactgcagccttgacctcctgggctcaagcaatcctcccacatagctgggagcataggcacatagcacaccactctcggttaaatttttttttttttttttttttttgtagagatagagtctcactatgttgctcaggctggtcttgaactcctggactcaaacagtcctcccaccttggcctcccaaaatgctgggaatacaggcatgagccactgcaccaggcctaatgtcctgattttataaatcccaaaactggggcccagagagaagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctaaaaggcagtcctcagagagaagcaaggttctgcatcttaagccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctttgagaaattgcatcttatttattgattatttattgaatggtagtttcatggagtttttggtcttttttcttttttgagacagtctcactcagttgcctaggctggagtgcagtggtgcgatctcggctcactgcaacctgtgcctcccaggttcaagcaattctcctgtctcagcctcccattacaggccacaccaccatgccccactaattgtacttttagtagagatggggtttcaccatgttggacaggctgttctcaaactcctgacctcaagtgatgtgtccgccttggcctcccaaagtgctgggatttgcaactgtgagccaccacacctagcctcttggtcattctttgaaaaataaacctcagccaggcgcgatggctcacgcctgcaatttcagcgctttgggaggctgaggtggcggatcacctgaggtcaggagttagagaccagcctgaccaacatggtgaaaccccatctctactaaaaatagaaaatttaaaaagaaaatcacctgggcctggtggcgcatgcctgtaatcccagctactcgggaggctgaggcaggagaatcgcttggacccaggaagcagaggttgcagtgagccaagatcaggccattgcactccagcctgggcagcaagagtgaagtgcagtctcaaaagataaaaataaaaaaaccctctagatatatgcagctccatattctcccaccacaagggtttataaatcctgagaaagaggcaaagcagggaacacatgaccacatagttctggcaggcgtcagattaccaggctgataaaacagatggtaaagtagaagctgtccgtcgacttttccattcccctttcagctcctccactgctacttaatctcctttgcccacacagttcaatcccattttccctgatctctaaatcctggctagattattagccattaacactagcttttacaaggagactcttcaatcttgtatttctaatagtataatttcacacgtacagaaattctttaagtcatagaagtcttacagatacagaaattctgatcttcaagagtccctttgtgaaacaaactaatttatcctgacagcaggaaagatttctgggcctaaggctctgtctcgttgacccaggtcatgctattcaggtggtccatctcttggttccaagcaagactgctgctgctgaccaacctgaatatggactttagcacttgagctcaagctgcactcagatggttagacccccataaaaagcagagggtacgttttctgttatgaaaagtaaagactgagccaggcgctgtggctcacgcccataatcccagcactttgggaggcaagttgggcggatcacgaggtcaggagatttaaaccatcctgggtaacacggtgaaaccccatctctactaaaaatacaaaaaaattagccaggcgtggtggcaggcgcctgtagtcccagctacttggaggctgaggcaggagaatggcatgaacccgggaggcggagcttgcagtgagccgagattgggccactgcactccagcctgggcgacagagcaagactccatctcaaaaaaaaaaaaaaagaaaattaaatactaaaaaaattaaacattataaccctgctaaggcaggaggatcatttgagcccaggagtttgaggctgcagtgagctatgatggcactactgcaccccagcctcagtgacagagggagaccctgtttctaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggctgggcgtggtggctcaggcctgtaatcccagcactttgggaggccgaggagggtggatcacctgaggtcaaaagttcaagaccagcctggtcaacatggtgaaactccatctctactaaaaatacaaaaattagccaggcgtagtggcaggcgcctgtaatcccagctactcaggagaccgaggcaggagaatctcttgaacccaggaggcagaggttgcagtgagccaagatctcgccattgtggtccagcccgggcgacagagcgagagtttatctcaaaaaaaaagaaagaaaaaaaaagaaaaaggaatgaaatgggccaggtgcagtggctcacgcctataatcccagcactttgggagcctgaggcggacagattactcaaggtcaggagttcgagaccagcttggccaacacagtaaaccccgtctctactaaaaatacaaaaattagctgggcatggtggcacacacctgtagtcccagctactggggaggctgaggcaggaaatcacttgaacccaggaggttgcagtgagccaagcaagattgcaccactccaccccagccgggcaacaagagtgaaactctgtctcaaaaaaaatgaatgaaatggctgtgtgaggtggctcatgcctatgatcccagcactttgggaggccgaggtaggaagattgcttgaatgtagaagttcaagaccagactgggcaacaaagtgagacccccatctctacaaaaaacttaaaaagtatccaggtgaggtggcacgtgcttgtcgtcccagctactggggagactgagatgggaggattgcttgcacctgggtgttgagactgcagtgaactgtgatcttgccactgcactccagagcctgggtgacagagcaaaattcctggggagagtgaagttatgatatgctgtaaatatatggatgagccttgaagacaatatgctaagcaaaataagccagagatgaagggccaaatactgtataattacactttatgaggtacctaaagtagtcaaattcagagacaggaagtggaatagtggttgccaggggctggtggcagtggggaataaggagttattgtttaatgttgtgggaagtcaaggaccccgaatggagggaccggctggagccgcggcagaggaacataaattgtgaagatttcatcttaatatggacatttatcagttcccaaataatacttttataatttcttatgcctgtctttaatatcttaatcctgttatgttcgtaagctgaggatgtacataacctcaggaccactgtgataattgtgttaactgtacaaattgattgtaaaacatgtgtttgaacaatacgaaatcagtgcaccttgaaaaagaacagaataacagcgatttttatggaacaagggaagacaaccataaggtctgacagcctgcggagtcgggccaaaagagccatatttttcttcttgcagagagcctacaaacggacgtgcaagtaggagagatatcactaaattattttcctagtaaggaatattaatattaataccctgggaaaggaatgcattcctggcgggaggtctataaacggccgctctgggaatgtctgtcttgtgccgttgagataaggactgagatacgccctggtctcctgcagaaccctcaggcttactagggttgggaaaactccaccctggtaaatttgtggtcagactggttctctgctctccaaccccgttttctgttgtttaagatgtttatcaagaaaatacatgcaccgctgaacacaacccttatcagtggttctgcttttgccctttgccttgtgatctttgttggacctttgtcagtggttctgcttttgccctttgtcctattccctcagaagcatgtgatctttgttagaaccttattagtggttctgcttttgccttttgaagcatacgatctttgtacccactccctgttcttacccccgctccccttttgaaacccttaataaaaacttgctggtctgagactcaggtgggcatcacggtcctaccaatatgtgatgtcacccccagcggcccaggtgtaaaattcctctctttgtactgtctctatttgtcagccggccgactcttatagaaaatagaaggaacctacgttgaaatattgggggcgagttcccccaatagtttaatgggtaaagactttcattgtacaatgatgtaaaaattctgggccagacgcagtggctcacgcctataatcccagcactttgggaggctgaggcaggccgatcacttggggtcaggagtttgagaccagcttggccaacacagtgaaatcccatctctactaaaaatagaaaaattagctgggtgtggtggtgcgtgcctgtagtcccagctactcgggaggctgaggtaggagactcacttgaacccgggaggtggaggttgcagtgagctgagatcgcgccactgcactccagcctgggggatagagcgagactccaaaagttctggaaatggataatggtgatagttgtacaacaatgtaatgtacttaatatcattgatttgtacacttaaaaatggttaaaatgggcttgttccagcagctcatgcctgtaattctagcgctttgggaggccaaggcaggagggtcacttgagaccagagttcgagaccagtctgggcaacatagcaagaccctgtctctaaaaataaaaaaataaataaataaatggttaaaatgaggccatgcatgcctgtaatctcaccgctttgggaagatgaggcggtagggtcacttgtttgggaagaggaggtgggaggatcctttgaacccaggagttcaaggctgcaatgaactatcatggtgccattgcactccaacctgggtgacagagtaagacctagtctctaaaaaaataagagttaaggccagacacggtgactcacgactgtagtctcagcactttgggaggctgaggcgggcagattacaaggtcaggagtttgagaccagcctggccaacatggtgaaaccccgtcgtactaaatatacaaaaatcagctggccgtggtggcatgtgactgtaatcccagctactcaagaggctgaggcaggtgaatcgctggaacccgggagccagaggttgcagtgagccgagatcagaccactgcactccagcctgggtgacagagcaagactctgtcttgaaaaaaaaaaaaattaaaaaaagaaacatggcccagtgtggtggctcttgcctataatcccaacactcagggaggccaaggtgggaggattgcttaagcccaggagttcgagaccaggcaacatagggagaccccgtctgtacaaataattttaaaaattagccaggtgtggtggtgcatgcctgtggtcccaggtgctcaggaggctgaggtgggaggactggctaagcctgggaggttgaggctgcagtgagctatgatcacaccactgcactccagcctgggtaacacagtgagacaccccgtcttaaaaaacaaacaaacaaataaacaaatactatgcataaaacctcaaggctcaagaaacaacagtttgaaatagttagatgtgtgttttttaattttcatgtcttatcttttctgttttttgtttttttttttttttttttagagatgagatcttgctctgttgcccaagctggtatcgaactcctcctgggctcaagcaatctcctgcctaggactccctcctaacagctggaactacaagcatgaaccactgcacccagctactggtgtattgtttcagtagtctttttaaaaaatgttaatatcttggtaaaaaatatatttatactgttctctaacctgcttttttcatcagtgtgatggaaaaatgctcatcatatattcttctgctatataactttagatgtctacactgatttcatttatgacatcacaattaaactggttaaaccaaattcatattgctcacttgtttctaattttttctctattaaaatgatatgataagcatccttgtagccaaatatttacacacattcattaaggtttacttaaaagaaattcctagacgtggagctgagtcaaagagaagggatcttttaagtatttttgcactgattgccatgaaaaggtcataccagtttatacattcatcaatatatgagtttcttttctaaatcttcttcaacatcatgtgagagacagttaaagcatagttgttcagagcccaggcttgagaatcagatttcaaaggtatgaaccctctccctttttcttttccttttttttttttttttctgaggagtcttgctcagtcgcccaggctggagtgcagtggcccaatctcggctcactgcaagtgtgtccagaattggtggattcttggtctcactgacttcaagaatgaagccgtggaccctcacgggagcattacagctcttaaaggtggcatgtccagagttcgttccttctgatgttcggatgtgttcggagtttcttccttctggtgggttcatggtctcgctggcttaggactgaagctgcggaccttcgtggtgagtgttacagctcttaaggcggcgtgtctggagttgttcgtttttcccggtgagttcatggtctcgctggcttcaggagtgaagctacagaccttggtggtgagtgttagagctcataaaggcagtgtggacgcaaagagtgagcagcagtaagatttattgcaaagaacgaaagaacaaagtttccacagtgtggaagggggaccccagcgggttgccactgctggctagggcagcctgcttttattctcttatctggccccactcacatcctgctgattggtagagcccaggggtctgttttgacagggcactgattggtgcgtttacaattcctcagctagacacaaaagttctccacgtccccaccagaatagttagatacagagtgttgacacaaaggttctccaagtccccaccagagtagctagatacagagtgttgattggtgcattcacaaaccctgagctagacacagggtgctgattggtgtgtttacaaaccttgagctagatacagagtgccgattggtgtatttacaatcccctagctagacataaaggttctccaagttcccactagactcaggagcccagctggcttcacccagtggatcgtgcactggggctgcaggtggagctgcctgccagtcccgcaccgtgagcccacactcctcagcccttgggtggtcaatgggactgggctccgtggagcagggggcggcgctcgtcagggaagctcaggctgcacaggagcccacggaggcggggggaggctcaggcatggagggctgcaggtcctaagccctttcccgtgggaaggcagctaaggcccagcgagaaattgagcacagcgccagtgggccggcactgctgggggacccagcacaccctccgcagccgctggcccaggtgctaagcccctcattgcccggggctggcagggccagctggcggctccgagtgtggggcccaccaagcccatgcccacctggaactccagctggcccgcaagtgcggaacgcagcctcagttcccacttgcgcctctccctccacacctccctgcaagctgagggagacggctccggccttggccagcccagaaaggggctcccacagtgcagcggtgggctgaagggcttctcaagtgccgccaaagtgggagcccaggcagaggaagtgctgtgagggctgccagcacgctgtcacctctcacaagctccacctctggggttcacgccattctcctgcctcagcctctggagcagctgggactacaggtgcctgccaccatgcccagttaatttcttgtatttttttttagtagagatggggtttcactgtgttagccaggatggtgtcgatctcctgacctcatgatccacccgcctcagcctcccaaagttctgggattacaggtgtgagccaccgcgcccatcccctttttctttttagagacagggtcttgctatgttgtccaggttggtgcgaaactcctggccttaagcaaccctgccacctcagcctccaagtaaactgggattacaggcgtgagccatcttgcccaacttccactttctagctgtgtgatcttcagaaaatcagttaaattctctgggccttaatttactgatagggttcttgtaagtattaaccattagctactattgagaggtgaagaccgctgggcttctgggttgggtggggacttggagaacttttttgtctagctaaaggattgtaaatgcaccaatcagcactctgtgtctagctaaaggtttgtaaacgcaccaatcagcactgggtaaaaacgaaccaatcagcactttgtaaaacgaaccaatcagcactctgtaaaatggaaaatcagcgctctgtaaaatggaccaatcagcaggacatgagcagggccaaataagggaataaaagctggtcaccccagctagtagtggtaacctgcgtgagttccgctccaggctgatggaagctttgttcttttgtacttcacaataaaccttgctactgctccttctttgggtccatactgcatttcagagctgtaacaccgtgaaggtatacagcttcactcctgaagccaagaccatgaacccactgagaggaacaagaaaaacaactctggacctgctgcctttatgagctgtaacactcaccttgaaggtctgtggctttactcttgaagtcggtgagaagcgagaccatgaacccaccagaaggaacacattccggacgcatctgaacatcagaggaaacaaactccagacacactacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaaggtaattagaactgacagggaattgtatgattaatgacgtgggacatgagagatttggaacgagataaaaaggcttaccttgaggacagccttattaggagcagaggcaaacacaggttttgtgggtttgaagcctacacatttatagctttctctaattacacaggtaggaaattataaaatcaggtacaagggcttggcaggggcctaaagcttaagtgatgaaaaaaaaaaacaccacacctctggtgaaaccaatagcttacgaaaaagtagaaaaaagcgcgatgcatggggagctccggtagtcctttgaggtatttgagaggctgagtcaggaagatggcttgagcaccaggagttggaggtttgtaagtgcagtgatggtaaactgccgctgtactccagtctggcaatgtagtgagaccctgtctctcaaaaaaaaaaagtaacccttgcctgactgggacaataattgagaaaccagtaaaacaaaataataactattagccgggcgcggtggctcatgcctgtaaatcctagcattttgggaggctgaggcgggcggattacaaagtcaggagtttgagaaattactacctattaccccatttggctatttttacacttgtaaggaatgaagctcagaggtcacacagctagtaagaagccagcacccttcgatgtgggattgatgtggaggataggcatatacagagaacacaaaagcaaaacaccatggtgcagattttgaaagaaaagccctaagattagtaatgagtgtgaattattcaacaaagtgatcaaaactaactccagctctgcattcctcttcgccatcaggagtttggagcctggagactgctagctgcctggttctttaagaaccagccctggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccaggtgactcacctccgctaattgttccgtgttcgttcgcctttcactttgtgtgtctcccccgccccacgcttttcgcttatgtgtatgcccccccgccgcgcccccgggctatattgcccaggcaggtttcgaattcctggtctccagctatcttcccgcctctgcctccctaagagctgggattacagggtgagccaccgcgcccggcactttgaggggagttacactttttttttttttccgtccctgcccttttcacacgaagaagggatgtagcttccaaccttccggaggttagtgtaaagaaacaggaatggaatggaaagctgattggggaagtgtccctgccgctccaaaactgagaggtccctcaaacctagtgctcagttaaaagacattgtaagggccaggcgcagtggctcacgcttgtaatcccagcactttgggaagtctcggcgggcagatcacgagatcaaaagattgaggccatcctgactaacacggtgaaaccccgtctctactaaaaatacaaaacagtagctgggcgtagtagcgggcgcctgtagtcccagctactcgggaggctgaggcaggagaatggtgtgaacccgggaggcagagtttgtagtgagctgagatcgcgccactgcactccagcctgggcgacagagcgagactccgtctcaaaaaaaagacattgtaaggaaaggaaaaagacacttatattaaaaacaaaacaggccgggcgcggtggctaacgcctgtaatcctagcgctttgggaggccgaggccggcggatcacctgaggtcaggagttcgagaccagcctggccaacatggtgaaaccccatctctactaaaaatagaaaaattagccaggcgtggtggtgcatgcctgtagtcccaactacttaggaggttgaggcaggagaatcgctggaacccgggaggcagaggttgcagtgagctgagatcatgccattgcactccagcctgggggacaagagtgactctatcttaaaaaaaaaaaaaaaaaattcaggtagtttcaattttttaatgttcttatttatgtattgactaggaagccacttttttttttttttaaataagaattccgactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccccgctggctggctatgatctccctgttaccattccaggagagcagccgcgtccctatgcatggcaggaccaggtactattgtggcctctcctcttggcctcgaatggtatctttgtcatcagtgagcaagtccccaaagaccacggtcttgtccattgtcaggataattcactccacaagctggggctccaggtgctgccctacccagcggtgcttctcacccacacagtggtcatactttggcaggggctggtgcagtgtgaagacctcggtgttttgcatgtgcttcatctcttgcaaggtcctccggggttgggcttcaagactagggaaaagcctgggcttcacacccgtgggccactttatccaccaggtccggcagcagggtgaggtactgcttccagaccaggaagctgcggtgctgctgcagtgtcacatgcagctccctgagaaggggcggctgaagccccgcaggaggccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttgaattcgcacagtatgttaagatttatgtaaattagcatttacaataggaaaacctcttcctgtcaaatggaaatttgaggttactggatacttttatattacataaagagcaatcagccagtgtaaaaatgaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagcaacatattcatctgctctgggcaacaatttgtcttaacttacaaagttaaatatgttattctacttgtacatgtgcaccaggaggcatattccttataagaggccagatgagcagtctggattaatttaaaaaaagagcaaagtcaactggaaacagtccaaatgtccatcaacaatagaacagattaataaattgaggtatatttccagcagtcaaagtgattgaactacagctacaagaatcaacatctatcaagatatacaaaagaaaagaaaaaaaaagaatcaacatggatgaatctccaaaccactgttgagtgaaacagtcaaaccctaggagaacacattcagtatcattccatttagatacaattcaaaaactaggcaaaataaaatattaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattttttttttttttttttttttttttgagacagtgtctcgctctttcgcccaggctggagtagtggcacaatcttggctcactgcaacctccacctcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctggggttacaggcgtgagccaccggacccagcctgcattattactatttaattttgtgtgaaacacaaaacctttaatgtaaatgataaaaatatcagtaagtggagtcattcagaatgagtagccttttgagtctgtctccgttgagtaagtgcattctgttgagtgcactggagaggaatttgtgctcttctatgtagcagtctttctttttgtttcttggtggtgcaccattaaatggattcattcaccagttaaaggacatttgggttgtttccagtctttggctacaacgagtaaagtcactataaacacttgccagaggtttctggacgaacaggttttcatttctcgtgggtagatacctaggagtgggattgctgggtcacatgtgtggtaagtatatgtttaacttaaaccatccaactgtttcaggaatagcttagttttgcattttgttttgtttcttcccaagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggttagttcttctttcagatttatgggctatgatgtatcaggtctcttcttaaatggtctgggttttcacagaagttagctcattcatgacagccattccctaccccaacacacactaccttttttagtcacttcttatagacagtttctttttttgagatggagtctcactctgttgccaggctggagtccagtggtgcgatcttggctcactgcaacctccacctcccaagttcaagtgattcttgtgccccaccctcccgagtagttgggattacaggcacctgccaccatgcttggctaatttttgtatttttagtggaggcggggtttcacaatattggtcaggctggtcttgaactcctgacctcaaatgatccacctgctttgacctacccaagtgctggattacaggcatgagccactatgcccagcctaatatttgtatttttttttttttaagtagagatggggtttcgccatgttggccaggctggtctcaaactcctgacctcaagtgatctgcccaccttggcctcccagagtgctggaattacaggcatgagccaccacacctggcctcttatagacagtttctattcaattctatattactatatttcctgctagtaaagagattcgtagttgttattatgcaattttaaattccagtatttttttttttttttttttgagatggagtcttgctgtgtcacccaggctggagtgcaatggcatgatctcggctcactgcaaactccacctcccaggttcaattgattcttctgcctcagcctcccacgtagctgtgactacaggcacgtgccactactgcccggctaattcttgtatttttagtagagatgtttcaccatgttggccagactgatctcaaactcctgacctcaaatgatccacccgcctcagcctcccaaactgttgggattacaggcgtcagccaccactcccggccatgagatgatgtacttgttgatgatgactcagtttagttatgacagtgggaatgggtggctcaggtgggagacagaaaaagatcatgggagatacgagattaaggaactgagaaaccagagaataattgatagatcttccacatggttatcaccaagagtggtgatggacaaattgtggaaaggaagagatagaggggaggtaaattctcaaagttgcaaatctgggtaaatggtagaacctagattcagactcaggttcaactaacttccagggtggacacaactcaccatattccactgtttgtggaatcattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtat

SEQ ID NO: 144 - DNA, 44240 bp, Homo sapiens
accacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcctaaacagttgaaaaatgggatgaggactcatttcatccccagatgactacctataaggagtgattggctaggtgggtggctcacgcctgtaatcccagcactttgggaggctgaggcgggtggatcacccaaggtcaggagttcgagaccagccagcctgatcaacatggagaaaccccatctctactaaaaatacaaaattagccaggcatggtggcacacacctgtaatcccagctacttgggaggctgaggcaggagagttgcttgaacctgacaagcagaggttgcagcgagccgagatcgtgccaccgcactccagcctggataacaagagcaaaactctatctcaaaaaaaaaggagtgatttagggtgtccacagataaatgccctttagcctttgacataaagaatctttagttacaatgcaaacatcccagaaagaataccatattaccattatcaattattagaaattcttaaggaggctgggtgcggtggctcacgcctgtaatcccaacactttgggaggctgaggcaggcagatcaccagaggtcagcagttcaagagcagcatggccaacatggcgaaaccccatctctactaaaaatacaaaaaattagccaggcatggtggcaggcacccgtaatcccagctactcaggaggctgaggcaggagaatcgcttgaacccaggaggcggaggttgcagtgagccaagatcacaccagtgcactccaggctgggtgacaagagtgaaacttcttctcaaaaaaaaaaaacaaaaaaaacttaaggaatagttattatcatccgatatgatggcttattaagaaggaagggaacacatgataggtctgttttgaaaaggaatggggacagaacaaaatgttacacaaggtctgatcaaaagaggcttgttctggcttgtctttgtctgtcttggagtcacgggacaggtgtaaggccaaattgtgcacttcccagtcatgttaccttgggcaaataatttgaaatctgtagtttcccaatctgaaaattgagtctgatacctgttctaatttagtgttgattgatatgaacctcaaaattagaaacgtatgaaagttctttgcaaactaaaatatatgtgtgaggaattgttattattagtttagaggatggactgttgtccttagaaggcaagtctctgggtcctacagttagatgcactgggcgcttcgggaagaatttagggctatggggtactcagcaattaaaagagagggtgcttagagaagaaagaaaggacttattaatggagtttggaggctccttattatcgaaacttacacattacgtgaccagcattatgaggcagcaccccactcccaacaaatagccctctagaaccaaaagcagagtggcaggtccggggtccttttgtacatagacggcataaaaaattgactaagtcaatcctggcataactgcagaccaggccctggaatgagcaacccaccagcattatctgcatttctaggaacttgggctagaaggggaggaatggggttggaagggttaggccacatgcctctagttaaaacctgatgaacttcctagatccccagctggaaaacgtaggagttggactaaattcctctcctgcctctaatattttatgaatacagaactcaactcaaactgggtagtatctcagagattccaaatttagttccacttttctgtttgcttatcagtcgcttaccctcaccctctggtctgatacctttatcctgtacaagtggtcaaagtaggttgagtaacatgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaacttttttttgtagagacagggtcttactatgttgtccaggctggtttcaaactcctggaatcaagtgatcttcctgccttggcctccagaaatgctgggactatgcctggaatagatatgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaattttttaccatgcactcacacagctatacagctatctccagagattactctggaaactctgctataaagatgacctggtctaatgccttgatttgtttttttttttttgagacagggtctcactctcctggagtacagtggcgtgatcatgactcactgcagccttgacctcctgggctcaagcaatcctcccacatagctgggagcataggcacatagcacaccactctcggttaaatttttttttttttttttttttttgtagagatagagtctcactatgttgctcaggctggtcttgaactcctggactcaaacagtcctcccaccttggcctcccaaaatgctgggaatacaggcatgagccactgcaccaggcctaatgtcctgattttataaatcccaaaactggggcccagagagaagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctaaaaggcagtcctcagagagaagcaaggttctgcatcttaagccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctttgagaaattgcatcttatttattgattatttattgaatggtagtttcatggagtttttggtcttttttcttttttgagacagtctcactcagttgcctaggctggagtgcagtggtgcgatctcggctcactgcaacctgtgcctcccaggttcaagcaattctcctgtctcagcctcccattacaggccacaccaccatgccccactaattgtacttttagtagagatggggtttcaccatgttggacaggctgttctcaaactcctgacctcaagtgatgtgtccgccttggcctcccaaagtgctgggatttgcaactgtgagccaccacacctagcctcttggtcattctttgaaaaataaacctcagccaggcgcgatggctcacgcctgcaatttcagcgctttgggaggctgaggtggcggatcacctgaggtcaggagttagagaccagcctgaccaacatggtgaaaccccatctctactaaaaatagaaaatttaaaaagaaaatcacctgggcctggtggcgcatgcctgtaatcccagctactcgggaggctgaggcaggagaatcgcttggacccaggaagcagaggttgcagtgagccaagatcaggccattgcactccagcctgggcagcaagagtgaagtgcagtctcaaaagataaaaataaaaaaaccctctagatatatgcagctccatattctcccaccacaagggtttataaatcctgagaaagaggcaaagcagggaacacatgaccacatagttctggcaggcgtcagattaccaggctgataaaacagatggtaaagtagaagctgtccgtcgacttttccattcccctttcagctcctccactgctacttaatctcctttgcccacacagttcaatcccattttccctgatctctaaatcctggctagattattagccattaacactagcttttacaaggagactcttcaatcttgtatttctaatagtataatttcacacgtacagaaattctttaagtcatagaagtcttacagatacagaaattctgatcttcaagagtccctttgtgaaacaaactaatttatcctgacagcaggaaagatttctgggcctaaggctctgtctcgttgacccaggtcatgctattcaggtggtccatctcttggttccaagcaagactgctgctgctgaccaacctgaatatggactttagcacttgagctcaagctgcactcagatggttagacccccataaaaagcagagggtacgttttctgttatgaaaagtaaagactgagccaggcgctgtggctcacgcccataatcccagcactttgggaggcaagttgggcggatcacgaggtcaggagatttaaaccatcctgggtaacacggtgaaaccccatctctactaaaaatacaaaaaaattagccaggcgtggtggcaggcgcctgtagtcccagctacttggaggctgaggcaggagaatggcatgaacccgggaggcggagcttgcagtgagccgagattgggccactgcactccagcctgggcgacagagcaagactccatctcaaaaaaaaaaaaaaagaaaattaaatactaaaaaaattaaacattataaccctgctaaggcaggaggatcatttgagcccaggagtttgaggctgcagtgagctatgatggcactactgcaccccagcctcagtgacagagggagaccctgtttctaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggctgggcgtggtggctcaggcctgtaatcccagcactttgggaggccgaggagggtggatcacctgaggtcaaaagttcaagaccagcctggtcaacatggtgaaactccatctctactaaaaatacaaaaattagccaggcgtagtggcaggcgcctgtaatcccagctactcaggagaccgaggcaggagaatctcttgaacccaggaggcagaggttgcagtgagccaagatctcgccattgtggtccagcccgggcgacagagcgagagtttatctcaaaaaaaaagaaagaaaaaaaaagaaaaaggaatgaaatgggccaggtgcagtggctcacgcctataatcccagcactttgggagcctgaggcggacagattactcaaggtcaggagttcgagaccagcttggccaacacagtaaaccccgtctctactaaaaatacaaaaattagctgggcatggtggcacacacctgtagtcccagctactggggaggctgaggcaggaaatcacttgaacccaggaggttgcagtgagccaagcaagattgcaccactccaccccagccgggcaacaagagtgaaactctgtctcaaaaaaaatgaatgaaatggctgtgtgaggtggctcatgcctatgatcccagcactttgggaggccgaggtaggaagattgcttgaatgtagaagttcaagaccagactgggcaacaaagtgagacccccatctctacaaaaaacttaaaaagtatccaggtgaggtggcacgtgcttgtcgtcccagctactggggagactgagatgggaggattgcttgcacctgggtgttgagactgcagtgaactgtgatcttgccactgcactccagagcctgggtgacagagcaaaattcctggggagagtgaagttatgatatgctgtaaatatatggatgagccttgaagacaatatgctaagcaaaataagccagagatgaagggccaaatactgtataattacactttatgaggtacctaaagtagtcaaattcagagacaggaagtggaatagtggttgccaggggctggtggcagtggggaataaggagttattgtttaatgttgtgggaagtcaaggaccccgaatggagggaccggctggagccgcggcagaggaacataaattgtgaagatttcatcttaatatggacatttatcagttcccaaataatacttttataatttcttatgcctgtctttaatatcttaatcctgttatgttcgtaagctgaggatgtacataacctcaggaccactgtgataattgtgttaactgtacaaattgattgtaaaacatgtgtttgaacaatacgaaatcagtgcaccttgaaaaagaacagaataacagcgatttttatggaacaagggaagacaaccataaggtctgacagcctgcggagtcgggccaaaagagccatatttttcttcttgcagagagcctacaaacggacgtgcaagtaggagagatatcactaaattattttcctagtaaggaatattaatattaataccctgggaaaggaatgcattcctggcgggaggtctataaacggccgctctgggaatgtctgtcttgtgccgttgagataaggactgagatacgccctggtctcctgcagaaccctcaggcttactagggttgggaaaactccaccctggtaaatttgtggtcagactggttctctgctctccaaccccgttttctgttgtttaagatgtttatcaagaaaatacatgcaccgctgaacacaacccttatcagtggttctgcttttgccctttgccttgtgatctttgttggacctttgtcagtggttctgcttttgccctttgtcctattccctcagaagcatgtgatctttgttagaaccttattagtggttctgcttttgccttttgaagcatacgatctttgtacccactccctgttcttacccccgctccccttttgaaacccttaataaaaacttgctggtctgagactcaggtgggcatcacggtcctaccaatatgtgatgtcacccccagcggcccaggtgtaaaattcctctctttgtactgtctctatttgtcagccggccgactcttatagaaaatagaaggaacctacgttgaaatattgggggcgagttcccccaatagtttaatgggtaaagactttcattgtacaatgatgtaaaaattctgggccagacgcagtggctcacgcctataatcccagcactttgggaggctgaggcaggccgatcacttggggtcaggagtttgagaccagcttggccaacacagtgaaatcccatctctactaaaaatagaaaaattagctgggtgtggtggtgcgtgcctgtagtcccagctactcgggaggctgaggtaggagactcacttgaacccgggaggtggaggttgcagtgagctgagatcgcgccactgcactccagcctgggggatagagcgagactccaaaagttctggaaatggataatggtgatagttgtacaacaatgtaatgtacttaatatcattgatttgtacacttaaaaatggttaaaatgggcttgttccagcagctcatgcctgtaattctagcgctttgggaggccaaggcaggagggtcacttgagaccagagttcgagaccagtctgggcaacatagcaagaccctgtctctaaaaataaaaaaataaataaataaatggttaaaatgaggccatgcatgcctgtaatctcaccgctttgggaagatgaggcggtagggtcacttgtttgggaagaggaggtgggaggatcctttgaacccaggagttcaaggctgcaatgaactatcatggtgccattgcactccaacctgggtgacagagtaagacctagtctctaaaaaaataagagttaaggccagacacggtgactcacgactgtagtctcagcactttgggaggctgaggcgggcagattacaaggtcaggagtttgagaccagcctggccaacatggtgaaaccccgtcgtactaaatatacaaaaatcagctggccgtggtggcatgtgactgtaatcccagctactcaagaggctgaggcaggtgaatcgctggaacccgggagccagaggttgcagtgagccgagatcagaccactgcactccagcctgggtgacagagcaagactctgtcttgaaaaaaaaaaaaattaaaaaaagaaacatggcccagtgtggtggctcttgcctataatcccaacactcagggaggccaaggtgggaggattgcttaagcccaggagttcgagaccaggcaacatagggagaccccgtctgtacaaataattttaaaaattagccaggtgtggtggtgcatgcctgtggtcccaggtgctcaggaggctgaggtgggaggactggctaagcctgggaggttgaggctgcagtgagctatgatcacaccactgcactccagcctgggtaacacagtgagacaccccgtcttaaaaaacaaacaaacaaataaacaaatactatgcataaaacctcaaggctcaagaaacaacagtttgaaatagttagatgtgtgttttttaattttcatgtcttatcttttctgttttttgtttttttttttttttttttagagatgagatcttgctctgttgcccaagctggtatcgaactcctcctgggctcaagcaatctcctgcctaggactccctcctaacagctggaactacaagcatgaaccactgcacccagctactggtgtattgtttcagtagtctttttaaaaaatgttaatatcttggtaaaaaatatatttatactgttctctaacctgcttttttcatcagtgtgatggaaaaatgctcatcatatattcttctgctatataactttagatgtctacactgatttcatttatgacatcacaattaaactggttaaaccaaattcatattgctcacttgtttctaattttttctctattaaaatgatatgataagcatccttgtagccaaatatttacacacattcattaaggtttacttaaaagaaattcctagacgtggagctgagtcaaagagaagggatcttttaagtatttttgcactgattgccatgaaaaggtcataccagtttatacattcatcaatatatgagtttcttttctaaatcttcttcaacatcatgtgagagacagttaaagcatagttgttcagagcccaggcttgagaatcagatttcaaaggtatgaaccctctccctttttcttttccttttttttttttttttctgaggagtcttgctcagtcgcccaggctggagtgcagtggcccaatctcggctcactgcaagtgtgtccagaattggtggattcttggtctcactgacttcaagaatgaagccgtggaccctcacgggagcattacagctcttaaaggtggcatgtccagagttcgttccttctgatgttcggatgtgttcggagtttcttccttctggtgggttcatggtctcgctggcttaggactgaagctgcggaccttcgtggtgagtgttacagctcttaaggcggcgtgtctggagttgttcgtttttcccggtgagttcatggtctcgctggcttcaggagtgaagctacagaccttggtggtgagtgttagagctcataaaggcagtgtggacgcaaagagtgagcagcagtaagatttattgcaaagaacgaaagaacaaagtttccacagtgtggaagggggaccccagcgggttgccactgctggctagggcagcctgcttttattctcttatctggccccactcacatcctgctgattggtagagcccaggggtctgttttgacagggcactgattggtgcgtttacaattcctcagctagacacaaaagttctccacgtccccaccagaatagttagatacagagtgttgacacaaaggttctccaagtccccaccagagtagctagatacagagtgttgattggtgcattcacaaaccctgagctagacacagggtgctgattggtgtgtttacaaaccttgagctagatacagagtgccgattggtgtatttacaatcccctagctagacataaaggttctccaagttcccactagactcaggagcccagctggcttcacccagtggatcgtgcactggggctgcaggtggagctgcctgccagtcccgcaccgtgagcccacactcctcagcccttgggtggtcaatgggactgggctccgtggagcagggggcggcgctcgtcagggaagctcaggctgcacaggagcccacggaggcggggggaggctcaggcatggagggctgcaggtcctaagccctttcccgtgggaaggcagctaaggcccagcgagaaattgagcacagcgccagtgggccggcactgctgggggacccagcacaccctccgcagccgctggcccaggtgctaagcccctcattgcccggggctggcagggccagctggcggctccgagtgtggggcccaccaagcccatgcccacctggaactccagctggcccgcaagtgcggaacgcagcctcagttcccacttgcgcctctccctccacacctccctgcaagctgagggagacggctccggccttggccagcccagaaaggggctcccacagtgcagcggtgggctgaagggcttctcaagtgccgccaaagtgggagcccaggcagaggaagtgctgtgagggctgccagcacgctgtcacctctcacaagctccacctctggggttcacgccattctcctgcctcagcctctggagcagctgggactacaggtgcctgccaccatgcccagttaatttcttgtatttttttttagtagagatggggtttcactgtgttagccaggatggtgtcgatctcctgacctcatgatccacccgcctcagcctcccaaagttctgggattacaggtgtgagccaccgcgcccatcccctttttctttttagagacagggtcttgctatgttgtccaggttggtgcgaaactcctggccttaagcaaccctgccacctcagcctccaagtaaactgggattacaggcgtgagccatcttgcccaacttccactttctagctgtgtgatcttcagaaaatcagttaaattctctgggccttaatttactgatagggttcttgtaagtattaaccattagctactattgagaggtgaagaccgctgggcttctgggttgggtggggacttggagaacttttttgtctagctaaaggattgtaaatgcaccaatcagcactctgtgtctagctaaaggtttgtaaacgcaccaatcagcactgggtaaaaacgaaccaatcagcactttgtaaaacgaaccaatcagcactctgtaaaatggaaaatcagcgctctgtaaaatggaccaatcagcaggacatgagcagggccaaataagggaataaaagctggtcaccccagctagtagtggtaacctgcgtgagttccgctccaggctgatggaagctttgttcttttgtacttcacaataaaccttgctactgctccttctttgggtccatactgcatttcagagctgtaacaccgtgaaggtatacagcttcactcctgaagccaagaccatgaacccactgagaggaacaagaaaaacaactctggacctgctgcctttatgagctgtaacactcaccttgaaggtctgtggctttactcttgaagtcggtgagaagcgagaccatgaacccaccagaaggaacacattccggacgcatctgaacatcagaggaaacaaactccagacacactacttttcagaactgtattaagaactgtaacagtcactgcgagggtctgcggcttcattcttgatgtcagcgagaccaagaatccaccagaaggaaccaattccagacacagaattatttgccttcttact

SEQ ID NO: 145 - DNA, 42599 bp, Homo sapiens
cttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcctaaacagttgaaaaatgggatgaggactcatttcatccccagatgactacctataaggagtgattggctaggtgggtggctcacgcctgtaatcccagcactttgggaggctgaggcgggtggatcacccaaggtcaggagttcgagaccagccagcctgatcaacatggagaaaccccatctctactaaaaatacaaaattagccaggcatggtggcacacacctgtaatcccagctacttgggaggctgaggcaggagagttgcttgaacctgacaagcagaggttgcagcgagccgagatcgtgccaccgcactccagcctggataacaagagcaaaactctatctcaaaaaaaaaggagtgatttagggtgtccacagataaatgccctttagcctttgacataaagaatctttagttacaatgcaaacatcccagaaagaataccatattaccattatcaattattagaaattcttaaggaggctgggtgcggtggctcacgcctgtaatcccaacactttgggaggctgaggcaggcagatcaccagaggtcagcagttcaagagcagcatggccaacatggcgaaaccccatctctactaaaaatacaaaaaattagccaggcatggtggcaggcacccgtaatcccagctactcaggaggctgaggcaggagaatcgcttgaacccaggaggcggaggttgcagtgagccaagatcacaccagtgcactccaggctgggtgacaagagtgaaacttcttctcaaaaaaaaaaaacaaaaaaaacttaaggaatagttattatcatccgatatgatggcttattaagaaggaagggaacacatgataggtctgttttgaaaaggaatggggacagaacaaaatgttacacaaggtctgatcaaaagaggcttgttctggcttgtctttgtctgtcttggagtcacgggacaggtgtaaggccaaattgtgcacttcccagtcatgttaccttgggcaaataatttgaaatctgtagtttcccaatctgaaaattgagtctgatacctgttctaatttagtgttgattgatatgaacctcaaaattagaaacgtatgaaagttctttgcaaactaaaatatatgtgtgaggaattgttattattagtttagaggatggactgttgtccttagaaggcaagtctctgggtcctacagttagatgcactgggcgcttcgggaagaatttagggctatggggtactcagcaattaaaagagagggtgcttagagaagaaagaaaggacttattaatggagtttggaggctccttattatcgaaacttacacattacgtgaccagcattatgaggcagcaccccactcccaacaaatagccctctagaaccaaaagcagagtggcaggtccggggtccttttgtacatagacggcataaaaaattgactaagtcaatcctggcataactgcagaccaggccctggaatgagcaacccaccagcattatctgcatttctaggaacttgggctagaaggggaggaatggggttggaagggttaggccacatgcctctagttaaaacctgatgaacttcctagatccccagctggaaaacgtaggagttggactaaattcctctcctgcctctaatattttatgaatacagaactcaactcaaactgggtagtatctcagagattccaaatttagttccacttttctgtttgcttatcagtcgcttaccctcaccctctggtctgatacctttatcctgtacaagtggtcaaagtaggttgagtaacatgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaacttttttttgtagagacagggtcttactatgttgtccaggctggtttcaaactcctggaatcaagtgatcttcctgccttggcctccagaaatgctgggactatgcctggaatagatatgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaattttttaccatgcactcacacagctatacagctatctccagagattactctggaaactctgctataaagatgacctggtctaatgccttgatttgtttttttttttttgagacagggtctcactctcctggagtacagtggcgtgatcatgactcactgcagccttgacctcctgggctcaagcaatcctcccacatagctgggagcataggcacatagcacaccactctcggttaaatttttttttttttttttttttttgtagagatagagtctcactatgttgctcaggctggtcttgaactcctggactcaaacagtcctcccaccttggcctcccaaaatgctgggaatacaggcatgagccactgcaccaggcctaatgtcctgattttataaatcccaaaactggggcccagagagaagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctaaaaggcagtcctcagagagaagcaaggttctgcatcttaagccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctttgagaaattgcatcttatttattgattatttattgaatggtagtttcatggagtttttggtcttttttcttttttgagacagtctcactcagttgcctaggctggagtgcagtggtgcgatctcggctcactgcaacctgtgcctcccaggttcaagcaattctcctgtctcagcctcccattacaggccacaccaccatgccccactaattgtacttttagtagagatggggtttcaccatgttggacaggctgttctcaaactcctgacctcaagtgatgtgtccgccttggcctcccaaagtgctgggatttgcaactgtgagccaccacacctagcctcttggtcattctttgaaaaataaacctcagccaggcgcgatggctcacgcctgcaatttcagcgctttgggaggctgaggtggcggatcacctgaggtcaggagttagagaccagcctgaccaacatggtgaaaccccatctctactaaaaatagaaaatttaaaaagaaaatcacctgggcctggtggcgcatgcctgtaatcccagctactcgggaggctgaggcaggagaatcgcttggacccaggaagcagaggttgcagtgagccaagatcaggccattgcactccagcctgggcagcaagagtgaagtgcagtctcaaaagataaaaataaaaaaaccctctagatatatgcagctccatattctcccaccacaagggtttataaatcctgagaaagaggcaaagcagggaacacatgaccacatagttctggcaggcgtcagattaccaggctgataaaacagatggtaaagtagaagctgtccgtcgacttttccattcccctttcagctcctccactgctacttaatctcctttgcccacacagttcaatcccattttccctgatctctaaatcctggctagattattagccattaacactagcttttacaaggagactcttcaatcttgtatttctaatagtataatttcacacgtacagaaattctttaagtcatagaagtcttacagatacagaaattctgatcttcaagagtccctttgtgaaacaaactaatttatcctgacagcaggaaagatttctgggcctaaggctctgtctcgttgacccaggtcatgctattcaggtggtccatctcttggttccaagcaagactgctgctgctgaccaacctgaatatggactttagcacttgagctcaagctgcactcagatggttagacccccataaaaagcagagggtacgttttctgttatgaaaagtaaagactgagccaggcgctgtggctcacgcccataatcccagcactttgggaggcaagttgggcggatcacgaggtcaggagatttaaaccatcctgggtaacacggtgaaaccccatctctactaaaaatacaaaaaaattagccaggcgtggtggcaggcgcctgtagtcccagctacttggaggctgaggcaggagaatggcatgaacccgggaggcggagcttgcagtgagccgagattgggccactgcactccagcctgggcgacagagcaagactccatctcaaaaaaaaaaaaaaagaaaattaaatactaaaaaaattaaacattataaccctgctaaggcaggaggatcatttgagcccaggagtttgaggctgcagtgagctatgatggcactactgcaccccagcctcagtgacagagggagaccctgtttctaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggctgggcgtggtggctcaggcctgtaatcccagcactttgggaggccgaggagggtggatcacctgaggtcaaaagttcaagaccagcctggtcaacatggtgaaactccatctctactaaaaatacaaaaattagccaggcgtagtggcaggcgcctgtaatcccagctactcaggagaccgaggcaggagaatctcttgaacccaggaggcagaggttgcagtgagccaagatctcgccattgtggtccagcccgggcgacagagcgagagtttatctcaaaaaaaaagaaagaaaaaaaaagaaaaaggaatgaaatgggccaggtgcagtggctcacgcctataatcccagcactttgggagcctgaggcggacagattactcaaggtcaggagttcgagaccagcttggccaacacagtaaaccccgtctctactaaaaatacaaaaattagctgggcatggtggcacacacctgtagtcccagctactggggaggctgaggcaggaaatcacttgaacccaggaggttgcagtgagccaagcaagattgcaccactccaccccagccgggcaacaagagtgaaactctgtctcaaaaaaaatgaatgaaatggctgtgtgaggtggctcatgcctatgatcccagcactttgggaggccgaggtaggaagattgcttgaatgtagaagttcaagaccagactgggcaacaaagtgagacccccatctctacaaaaaacttaaaaagtatccaggtgaggtggcacgtgcttgtcgtcccagctactggggagactgagatgggaggattgcttgcacctgggtgttgagactgcagtgaactgtgatcttgccactgcactccagagcctgggtgacagagcaaaattcctggggagagtgaagttatgatatgctgtaaatatatggatgagccttgaagacaatatgctaagcaaaataagccagagatgaagggccaaatactgtataattacactttatgaggtacctaaagtagtcaaattcagagacaggaagtggaatagtggttgccaggggctggtggcagtggggaataaggagttattgtttaatgttgtgggaagtcaaggaccccgaatggagggaccggctggagccgcggcagaggaacataaattgtgaagatttcatcttaatatggacatttatcagttcccaaataatacttttataatttcttatgcctgtctttaatatcttaatcctgttatgttcgtaagctgaggatgtacataacctcaggaccactgtgataattgtgttaactgtacaaattgattgtaaaacatgtgtttgaacaatacgaaatcagtgcaccttgaaaaagaacagaataacagcgatttttatggaacaagggaagacaaccataaggtctgacagcctgcggagtcgggccaaaagagccatatttttcttcttgcagagagcctacaaacggacgtgcaagtaggagagatatcactaaattattttcctagtaaggaatattaatattaataccctgggaaaggaatgcattcctggcgggaggtctataaacggccgctctgggaatgtctgtcttgtgccgttgagataaggactgagatacgccctggtctcctgcagaaccctcaggcttactagggttgggaaaactccaccctggtaaatttgtggtcagactggttctctgctctccaaccccgttttctgttgtttaagatgtttatcaagaaaatacatgcaccgctgaacacaacccttatcagtggttctgcttttgccctttgccttgtgatctttgttggacctttgtcagtggttctgcttttgccctttgtcctattccctcagaagcatgtgatctttgttagaaccttattagtggttctgcttttgccttttgaagcatacgatctttgtacccactccctgttcttacccccgctccccttttgaaacccttaataaaaacttgctggtctgagactcaggtgggcatcacggtcctaccaatatgtgatgtcacccccagcggcccaggtgtaaaattcctctctttgtactgtctctatttgtcagccggccgactcttatagaaaatagaaggaacctacgttgaaatattgggggcgagttcccccaatagtttaatgggtaaagactttcattgtacaatgatgtaaaaattctgggccagacgcagtggctcacgcctataatcccagcactttgggaggctgaggcaggccgatcacttggggtcaggagtttgagaccagcttggccaacacagtgaaatcccatctctactaaaaatagaaaaattagctgggtgtggtggtgcgtgcctgtagtcccagctactcgggaggctgaggtaggagactcacttgaacccgggaggtggaggttgcagtgagctgagatcgcgccactgcactccagcctgggggatagagcgagactccaaaagttctggaaatggataatggtgatagttgtacaacaatgtaatgtacttaatatcattgatttgtacacttaaaaatggttaaaatgggcttgttccagcagctcatgcctgtaattctagcgctttgggaggccaaggcaggagggtcacttgagaccagagttcgagaccagtctgggcaacatagcaagaccctgtctctaaaaataaaaaaataaataaataaatggttaaaatgaggccatgcatgcctgtaatctcaccgctttgggaagatgaggcggtagggtcacttgtttgggaagaggaggtgggaggatcctttgaacccaggagttcaaggctgcaatgaactatcatggtgccattgcactccaacctgggtgacagagtaagacctagtctctaaaaaaataagagttaaggccagacacggtgactcacgactgtagtctcagcactttgggaggctgaggcgggcagattacaaggtcaggagtttgagaccagcctggccaacatggtgaaaccccgtcgtactaaatatacaaaaatcagctggccgtggtggcatgtgactgtaatcccagctactcaagaggctgaggcaggtgaatcgctggaacccgggagccagaggttgcagtgagccgagatcagaccactgcactccagcctgggtgacagagcaagactctgtcttgaaaaaaaaaaaaattaaaaaaagaaacatggcccagtgtggtggctcttgcctataatcccaacactcagggaggccaaggtgggaggattgcttaagcccaggagttcgagaccaggcaacatagggagaccccgtctgtacaaataattttaaaaattagccaggtgtggtggtgcatgcctgtggtcccaggtgctcaggaggctgaggtgggaggactggctaagcctgggaggttgaggctgcagtgagctatgatcacaccactgcactccagcctgggtaacacagtgagacaccccgtcttaaaaaacaaacaaacaaataaacaaatactatgcataaaacctcaaggctcaagaaacaacagtttgaaatagttagatgtgtgttttttaattttcatgtcttatcttttctgttttttgtttttttttttttttttttagagatgagatcttgctctgttgcccaagctggtatcgaactcctcctgggctcaagcaatctcctgcctaggactccctcctaacagctggaactacaagcatgaaccactgcacccagctactggtgtattgtttcagtagtctttttaaaaaatgttaatatcttggtaaaaaatatatttatactgttctctaacctgcttttttcatcagtgtgatggaaaaatgctcatcatatattcttctgctatataactttagatgtctacactgatttcatttatgacatcacaattaaactggttaaaccaaattcatattgctcacttgtttctaattttttctctattaaaatgatatgataagcatccttgtagccaaatatttacacacattcattaaggtttacttaaaagaaattcctagacgtggagctgagtcaaagagaagggatcttttaagtatttttgcactgattgccatgaaaaggtcataccagtttatacattcatcaatatatgagtttcttttctaaatcttcttcaacatcatgtgagagacagttaaagcatagttgttcagagcccaggcttgagaatcagatttcaaaggtatgaaccctctccctttttcttttccttttttttttttttttctgaggagtcttgctcagtcgcccaggctggagtgcagtggcccaatctcggctcactgcaagtgtgtccagaattggtggattcttggtctcactgacttcaagaatgaagccgtggaccctcacgggagcattacagctcttaaaggtggcatgtccagagttcgttccttctgatgttcggatgtgttcggagtttcttccttctggtgggttcatggtctcgctggcttaggactgaagctgcggaccttcgtggtgagtgttacagctcttaaggcggcgtgtctggagttgttcgtttttcccggtgagttcatggtctcgctggcttcaggagtgaagctacagaccttggtggtgagtgttagagctcataaaggcagtgtggacgcaaagagtgagcagcagtaagatttattgcaaagaacgaaagaacaaagtttccacagtgtggaagggggaccccagcgggttgccactgctggctagggcagcctgcttttattctcttatctggccccactcacatcctgctgattggtagagcccaggggtctgttttgacagggcactgattggtgcgtttacaattcctcagctagacacaaaagttctccacgtccccaccagaatagttagatacagagtgttgacacaaaggttctccaagtccccaccagagtagctagatacagagtgttgattggtgcattcacaaaccctgagctagacacagggtgctgattggtgtgtttacaaaccttgagctagatacagagtgccgattggtgtatttacaatcccctagctagacataaaggttctccaagttcccactagactcaggagcccagctggcttcacccagtggatcgtgcactggggctgcaggtggagctgcctgccagtcccgcaccgtgagcccacactcctcagcccttgggtggtcaatgggactgggctccgtggagcagggggcggcgctcgtcagggaagctcaggctgcacaggagcccacggaggcggggggaggctcaggcatggagggctgcaggtcctaagccctttcccgtgggaaggcagctaaggcccagcgagaaattgagcacagcgccagtgggccggcactgctgggggacccagcacaccctccgcagccgctggcccaggtgctaagcccctcattgcccggggctggcagggccagctggcggctccgagtgtggggcccaccaagcccatgcccacctggaactccagctggcccgcaagtgcggaacgcagcctcagttcccacttgcgcctctccctccacacctccctgcaagctgagggagacggctccggccttggccagcccagaaaggggctcccacagtgcagcggtgggctgaagggcttctcaagtgccgccaaagtgggagcccaggcagaggaagtgctgtgagggctgccagcacgctgtcacctctcacaagctccacctctggggttcacgccattctcctgcctcagcctctggagcagctgggactacaggtgcctgccaccatgcccagttaatttcttgtatttttttttagtagagatggggtttcactgtgttagccaggatggtgtcgatctcctgacctcatgatccacccgcctcagcctcccaaagttctgggattacaggtgtgagccaccgcgcccatcccctttttctttttagagacagggtcttgctatgttgtccaggttggtgcgaaactcctggccttaagcaaccctgccacctcagcctccaagtaaactgggattacaggcgtgagccatcttgcccaacttccactttctagctgtgtgatcttcagaaaatcagttaaattctctgggccttaatttactgatagggttcttgtaagtattaaccattagctactattgagaggtgaagaccgctgggcttctgggttgggtggggacttggagaacttttttgtctagctaaaggattgtaaatgcaccaatcagcactctgtgtctagctaaaggtttgtaaacgcaccaatcagcactgggtaaaaacgaaccaatcagcactttgtaaaacgaaccaatcagcactctgtaaaatggaaaatcagcgctctgtaaaatggaccaatcagcaggacatgagcagggccaaataagggaataaaagctggtcaccccagctagtagtggtaacctgcgtgagttccgctccaggctgatggaagctttgttcttttgtacttcacaataaaccttgctactgctccttctttgggtccatactgcatttcagagctgtaacaccgtgaaggtatacagcttcactcctgaagccaagaccatgaacccactgagaggaacaagaaaaacaactctggacctgctgcctttatgagctgtaacactcaccttgaaggtctgtggctttactcttgaagtcggtgagaagcgagaccatgaacccaccagaaggaacacattccggacgcatctgaacatcagaggaaacaaactccagacacactacttttcagaactgtattaagaactgtaacagtcactgcgagggtctgcggcttcattcttgatgtcagcgagaccaagaatccaccagaaggaaccaattccagacacagaattatttgccttcttact

SEQ ID NO: 146 - DNA, 204084 bp, Homo sapiens
aaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 147 - DNA, 205569 bp, Homo sapiens
actgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 148 - DNA, 128914 bp, Homo sapiens
attttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactac

SEQ ID NO: 149 - DNA, 192179 bp, Homo sapiens
attttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 150 - DNA, 198083 bp, Homo sapiens
agaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 151 - DNA, 639624 bp, Homo sapiens
agaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaatatttccctgcaaatagttttcacattgttacctaatgataggttgacaaaagcctgaggggtcaaaccagtctaaagatgctaagtcttccaggttgtttttgaaaatgaaatgtaaatgtcattctttagtataagttctagtctacctcccactactgttcttgcccctccttttttttttttttgagatggagtcttgctctgtcgcccaggctggagtacagtggcgtgatctcagctcactgcaagctccacctcccgggttcatgccattctcctgcctcagcctcccaagtagctgggactacaggcacccgccaccatgcctggctaatttttttgtatttttagtagagatggggtttcaccgtgttagccaggatggtcttgatctcctgacctcatgatccgcacgcctcagcctcccgaagtgctggaattacaggcatgagccaccgcgcccggcctgcacctccatttttagtgtgaggatggaaagaagatgttttaattttttttcagagcacaaataatttatagagttttataattctggagaaaacctttcttttgttgttgtaagtgcaaaaattaaggtagctttttctaattacagaaataatttagaaaatacaagaaagaacagaagaaaataacaataaattcatatttgtccttcaattctcttttctactcagacacatgtgtacacatgaacacatataccccctcccttatatattggggattacattgaaacatactgatgtaaacttgcttttttcacttaaaatattatgaacttttttcagtgtaactaaagctaatctgaacattattttaaattaatagctgtctaatatctgaacaatccctttttgttggacaattaggttgtttccaggtttttttcacaattataaataatatatatcaaagagttatctatactcccaagttcattgcagcagtattcacagtagtggaatggaatcaacctgaatgtccctcagtggatgaatggataaagaaaatgtgacacatatacactgtggactgtaacacagccatttaaaaagaatgaaatccttgtcatttgcaacaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgaggtggggggatcatgaggtcaggagttcgagaccagcctgactaacatggtgaaaccccgtctctactaaaaatacaaaaattagccaggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagttggagcagtgccagcggcaagcgaacaaggtgacggaaatcacgcttaacaactttgacaaggtcctggagcatgatggaaagctgaccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccagagaaccttggtgtttgctctcccctgacccaccccagtgagtgccaaagggcagccccaacacgtgcacccctgcatttcttgtcatgccacagactggccctcgagggcaccctgccatactggccatgccgggccagccccacctgaagctcagtgaaagctgattaaaaaaaaaaaattatgtatagatcaaaataactacaagagtggaaattgaatattcctaacaaaaagaaatgatacatgcttaatgagtttcacaactacccttatttgatcgttacatgttttatacttgtatcaaaatggtgcatgtactccataaatatgtataactattatgtagccataactaaaaatttaaaatttatataaaaacagtattccataggactaccaaactagggaaattactgcccccattttctcattagatttttcttcactagagtagtataacatgaccgagaatttgggcttgctcagctctccacactgaccggccgaatgaccttggatatgtcatttaacctataagccactgttttctcatctgtcaaatgaagataatattaatagctgcattatagggttatgagaattagatggtaatttctgtaaagtgtcacagtgcctgggatataatatgaaatcaatgaagtgtagtggttatttttacttattattatacatacattttttattatttccttatgacaaattctcagaagtgggattgctaaggtaaaaatattagtattgtaaagatttttgatacatagtgctatcaaaactcttaggtaaaaaatgctcttggttttataaagcctacgccttcagaatgttgtactaatttacacttgtagcttcaccatataagagtatgagtttcttgggattctcacccgtacttgatattattaaaatattttttgccagttggataagcagaaggttggcatttagttatttctttagctacatttcaatgactaaatgctcaaatttaagatttttcaaaatgttttgcaatgacaatagtctgtgaaactgaaaaatatgtaacacattaatttttgttaaagatgtgtggtctgaattagttaattcatagagcatctttacctaccactttattacttaaaccaacaggtaagagttttagtagagagggctgttaggcttgctttaatgagtacatgagattttattataattata
